United States Patent 10,233,495 (METHODS AND COMPOSITIONS FOR SCREENING AND TREATING DEVELOPMENTAL DISORDERS) - sequence listing, part 22

SEQ ID NO: 101 - DNA, 626992 bp, Homo sapiens
  misc_feature (205792)..(305791): n is a, c, g, or t
agatttttagtgagtgagccagatggtttacgtttaattttgttaataattagttaataaattaatctatttgtatttccattttatttagaataggtgaatttgtttattatgtggaatggtgcttctgttttgccttttttttttgagaaatctctaaactgctttccacagtagttcaactaatttgcattccaccaacagtgtataagcatttccttttctctggatcctcaccagcatatggttttttttttttttttttactttttaataatagctgttatgactagtgcgagatggtctcattgtgattttgatttgcatttctatgatgattagtgatgttgagcatttttgtcatatgtttgttggttccttgtatgtcatcctttgagaagtacctgttcacatcttttgcccagtttttcatagggttacttgatttttgcttgttgaattattcaagtttcttatagattctggatattagacctttaacagatgtgtagcttgctaatatattcttccattcaataggttgtttgtttattctcttgatagtctgctgtgcagaagctcttcagtttacatctcacttgtgaattttgagttttgttgcaattgctattgaggacttagttataaattctttcccaaggctgatgtctagaatggtatttcctagattttcttcaattattcttatagctttaggtcttatatttaaacatttaatccatcatgggttaatttttgcatggtgaaaagtagaggtccagttttgttcttttccttatggctagcaagctatcccaccatcgtttattgaatagggagtccttttctcctttgcttatttttgttgacttagtgatggatgactataggtctgttgctgtatttctgggctctgtattctgtttcattgatttatgtgtctgtttttgtaacagaaccatgctgttttggtatctgcagccttatagtttgaagttgggtaatgtgatgcctctggctttgttctctttgcccaggcatgcttcagctatttggactaacttttggttttatggaaatttttgaatatttttttctaattctgtgaataatgacattggcattttaataggaatagcatttaatgtgtggatggctttggttaggatggttattttaatgatactgattcttccagccttgagcataaaatgttctaccatttgtttgagtcatctatgatttatttcagcagtgctttgtagttcttgtagaaatcttttgtctcctcggttagatgtatttttaagtatattttgtttatgtgactggtgtaaatgtgattttgttcttgatttgattctcagcctgaattcttattggtgtatagaaatggtattgatttttgtacattgattttgcatcttgaaaccctactgaagtcatttttcagttctagcaggctttaggcagtctttaggattttctaggtatagaatcatatcatcaggaaagagagataccttcaattcttttcctgtttggatgccttttatagctttctcttgcctaagtgctcaattagtacattattgaaatagaaagtgctgttattttaatcatttatatttgaaacataaaatttaaaaaatgtattagcctatgttaagtccaaattcattgcggaaatgtactcatccacctaataataataatagttgtagcaaattgaatattactatatacagcaattacttacagcaactcttttagcctcagcaatgctattaagtaggtagtgccattgcctcatctccatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaacatagaatcacatttttttcgtacgtatatattaattataatattattacaggtgtatgattcaaatatgtaaaaatatttttctggttgtctatcactgcttaaccaactgctctcaaatgaaggtgcttagaacagcaacattttatcatcgcctgttttaattctaggttgttggccaggctcaattaggtgtttatggcacagcatttctcaactggttactgtcctaaggtagcttaggctaatcatctgaaggttaatcactcacatatctggtaattagtattaaaagtctcaagctactggagtgctggaccaattgtgacttcttaggcatacatatgtatttctacaccaaatggtatatttctcctggggactgtggatatggcacagggctccaaagtgagtggagagaccgagagaaaggaaaaaaaatgacagaaacacagagaaaaggacagaaggacagacagagaaaatgtattcacaacttttttgagctttggaagttaagctcctcacttccactatattctcttttttaagacagccacaaagtttgctaaatttcacaggaagggtatatgacttgattagaggattgccaatgcatttgtaatcacatcccaaaattactgcaaatataaccttaaaaattagaagaaatcactaaattactatagaattcataaaatgttgacataagacagtaaaatttaaaaaaattttgtatttaaattttaaccatgattaaaaattttaattaacattctaatatatttattcataaatatttaaaatatcaagtaggtgtccaaaaacaatctgtaaatttatcagatagagagtaccagattcctggtcaatttaagttttctaaatggcactaatagattgataatattatattaaaacctaagaacatgctatctcaaatcaatgtttatttcactaattaatttttaaaactatataattaaatataaaaacaaatttgtgcaaggttagtgaatgaagtatgtagaatcaaaattaaaagtagaatcctctatgtttatacagatttacagattcttaattttatttcaaagaagtatactcatttttttctggaacttgtttttcatttagcaatgtgatgtggagaacattccctgatattgtctgtaatatgcctgttctctgtaattacttcataccttctactttttgtgggaggtatgtatgtgcactgactgatagccatgtaagtgatggagggaacaacctgtacatacacgcactcaggtgcaagtgtatctggatagcagatgactagatgtagaattgcagagtcaaactctaagtataattttttttgtaagggttatttcactttatactctctcacaaactcttttctcaggttcttatgtttgatcaatcttctgtgggaaaataattcattgactttttatggctacatagtaatccatggtgtatacatactgcactttccttattcagtctatcattgatggacatttaggttgatttcatgtctttgctattgtgaatagtgttgtaatcaacatatatgtgcatgtgtctttataatagaatgattatattcctttgggtatatacccagtaatgggattgctgggtcaaatggtatttctgtcattaggtcttggaacagacaaccaaatgctgcatgttctcacttacaagtggaagctaaataatgagaacacctggaacacatgaacaacacacactggggcctattggagggtagaaggtgggaggggggagaggatcaagaaaaataagtagtgggttctgggcttaatacctgggtgatgacacatatttgcctatgtaacaaacttgcacatgtacccctgaacttaaaagttaaaaaagttcattgacttaacattattgacttaataaattataatgtccaattttctagtacaagtagcttttgtcatctttttgatgtgattggccatttttacttctgtgaattgtcaattcatatccttcatctattttcatattggtctgtttgtctttttggttggtgatatataatagctctcattgtacaagggataccagtcctttgtctacgtattgcaggataggcttgatgtaaattactttaggttggtatgcatgatgtaacaatattatctgctatgacactatatttattcaatatttcttaaaaatgtttcatttatctggatacattttataaaaattctgctgcaatctcttccaataattcccttagcatcaaagttttaatttatttttagaatacattcatgccataggtcatagagtggttgttgtgagacttggatgatggtcttcttgccaataaagacacaaaggtttttgttaacccatactactttgatcacaaagtgtttccttgatgtgtagcttttaggagggccttgagaattcctgagattttattatttgccatttttttggtaatttttgtgttcttgatattattactgattatgattagttgcaatatgtttacattaaaaatgattatcttatttttagtcatgctaaatgacttatgttttcatattagtgttatgggatgaatagagctacaggcttctgtggaaagagagaaacatgagacatccttatataaaatagggttatatagaataatggtcacttttaactgtcttctacaaacacattcagtttcacaaacatctgtaaggtagctcaataattctgtgccttgttttggaagaagtgaacacatatatacatgtacagttgtgataatcaaaatcggtaagtccccttaaagtgctggttctatattatcacaacctacaattcagacatttaatccactattaacgtttataaatgaccgtgaaagcaaccagttcacactttagaaaagttcatggggaaaagacaattagcttgtgaacaaaggttttcccaaatagttaaattttgtagtatttgtcaggtaggagtcattctatctctaatttgtcatatattgtgcttttgatccttgaacaacatggaggtttgaactgaacctctgattatatgcagattttcttttgcctctgccagcctgagataacaaggccaacttctctttctcttcctcctttgcctacttaatgtgaatacatgaagaagaaaacctttgtgatgatccacttccacttaataaatagtaaacatatttaaccttccttgtgattttcttaataacattttcttttgtctatcttactttattgtaaaactatgatatacaatacatatagcatgcacaatatgtgttaatttactgtttatgttattggtaaggcttctggccaacagtaaactatctgtagttaaattttgtggagtcaaaagttataaatggctttttgatggtgtgataggagagatttgcccgtaggtccactgctgttcacaggtcaactttactgcaaaatgatttaagttggcagaagccaaatgcactgccatatttttttagaaaagaggtgatgttgtagccggatgcacattaaggactagcagcattacttgtctccaaaccacagaggaatatggtggtcccagattttcagttttgttccccaactccatgtatctgagtcccattattttgctcttcaggccctaaatgtggcataaagtgtagtagaggcggacagtgtcgtctcctgtgcatcactgttgttttgcgatgaaattctcaatgtggtcagctgctgctgctgcagaagtcgattttcttcaaacactgccaagaacatctgacttacatagcatattttgatttgatatttattcaaactgagccttttttctttttacaagctctctgaaactgttaaaagtcttcactttataaactatgtagttaccatgatctttatactgttggtaaagcaatgattcactttccccgtgtctttcacctcagttcttttcttccctgtgtgaattgtatccattttgatcaaagtgattttactgaataccaggagttatcacctctcaagtgttgttggcaaggagactgtttttgccagttatcagtgagttattaaattccaaagtcccattttgagggtctgctttttagtgccacttgcccaagctgccatagtctatttttctcagaaagcaaagcctgagataagaattagtgtgcaataactaatttgagaaatgttcttagggtacaggagtaggggacaggaaagggtgaaacaagaagggagaaaagtcagtacaagaatgtgttaccaaactaatcatcaccgtgactgttgggacttaagctcatgtggacccagtaggaagctgtgtggatgtaaggcgtgatcattaaccatcactttctattgttcacactgccaggttatgcacatgtgagtgagtgttagctgagtttctttgacggttccatgaagagatgttaaagaagactggtgcagaaaatgagagacctgtcctatcagaagatgactttacaaagctccttgacacagcaaaggctagagaaaaaaaaattagctgaaaaatatggggtgcaacctaatttgatcaaatgtattagagctttcttttttcttttgtttcattttcacagtatattacatttcatatgattgaatactgtaaattttctcagttttctgataaagttatgtctgtgatacaggaactagaaagaaattattcaggcagatagtgagggtgagagtcctcggtaaggttttgttttaataaaaagcagctccgcaaatcatttccttgctaacaaaaagcagcctgaaaaatcaagcttcaaacatagagaaacaagctaaaagcttgcataggtagggaaaagaaagagagatcagactgttactgtgtctatgtagaaagggaagacataagagactccattttgaaaaagacctgtactttaaacaattgctttgctgagatgttgttaatttgtagctttgccccagccactttgccccagccactttgacccaacctggagctcacaaaaacatgtgttgtatgaaatcaaggtttaagggatctaggactgtgcaggacatgcctttttaacaaaatgtttacaggcagtatacttggtaaaagtcatcaccattctctagtctcaataaaccaggggcacaatgcactgcggaaagccgcagggacctctgcccttgaaagctgggtactgtccaaggtttctctccatgtgatagtctgaaatatggcctcatgggatgagaaagacctggctgtcccccagcctgacacccgtaaagggtctgtgctgaggtggagtagtagaagaggaaagcctcttgcagtcgagatagaggaaggccactatctcccgcctgcccctgggaactgaatgtctcagtataaaatccgattgtacatttcttcaattctgagatgagagaaaaaaaccaccctatggtgggaggtgagacatgtttgcagcaatgctgccttgttattttttactccactgagatgtttgggtggagagaaacataaatctggcttacgtgcacgtccagtcatagtaccttcccttgaacttaattatgacatagattctattgctcacatgtttgttgctgaccttctccttattatcaccctgctctcctactacattccttcctgctgaaataatgaagataataatcaataaaaactgagggaactcagagaccggtgctggtgcagatccttggtatgctgagtgctggtccactgggcctactgttgtttctctatattttgtctctgtgtctcatttctctttctcagtctctcatcccacctgactagaaatacccacaggtgtggagggtcaggccaccccttcacttgctaacaaaaagcagcctgaaaaatcaagcttcaaacatagataaacaagctaaaagcttgcataagtaaatgctggcaactgtgccaataattcctcaaggatctagaactagaaataccatttgacacagcaatcccattactggatatatacccaaaggattctaaatcattctactataaagacacatgcacacatatgtttattgcagcactattcacaatagcaaagacttggagccaacccaaatgtccatcaatgatagactggataaagaaaacgtggcacatatacaccatggaatactatgcatccataaaaaagatgagttcatgtcctttgcagggacatggatgaagctggaaaccatcattttcagcaaactaacacaagaacagaaaaccaaacaccaattgttctcactcataagtgggagttgaacaatgagatcacatagacacagggaggggaacatcacacactggggcccgttgaggtgtgggggactaggggagggatagcatcaggagaaatatctaatggaggtgatgggttgatggttgcagcaaaccactgtggcacatgtatgcctatgtaacaaaactgcatattctgcacatgtaccccagaacttaaagtataattaaaaaaaaaaaaaagaaagaaaagggatgggataccttgaagccaggtatattcaacagggaggttccctctttcctttcctttgtcaaccacacgtgcaataaagaagcaggcaacatggcactggccaggtagagaaagcatatgcataatagaagattagggtggggcagcaagcttcttcttacactatgtaaatggcacccctggttccaccaatcctttgggccctatataaatcagacactgcttcctcaagcttgtctataaaacccagtgcatttcgccatggaactagaagatctatttgggatcacctttctgcaggaaagagagctattctcttttctctttctttcccctattaaacctccattcttaaactcacttctcgtgtgtccgtgttttcagtttccctggagtgagatgatgagtcttgggtatttaccccagacaatgatgctgcttaacctgttacttttatttattcttacttgaaaaatttttatttattttttatttattttacttaaattctgtgatacatgtacagaacgtgcaggtttgttacctaggtacacatgtgccattgtggtttgctgcacccatcgacccatcatctaggttttaagccctgcgtgcattaggtatttgttctaatgctctctgtctccttgtcccagaccccctgacaggctccagtgtgtgatgttcccctctgtgtctatgtgttctcattgttcaactcccatttataagtgagaacatgcagcatttggttttctgttcctttgttagtttgctgagaatgatggtttctatccacatccctgcaaaggacatgaactcatgcttttttatggctgcatagtattccatggtgtatatgtacacattttctttattcggtctatcattgataggcatttgggttgtttccaagtctttgctattgtaaatagtggtgcaataaacatacgtgtgcatgtctctttatagtagaatgatttgtaatcctttgggtatatacccagtaatgggattgctgggtgaaatcgtatttctgcttctagatccttgagcaattgccacaatgtcttccacaatggttgaactaatttgcactgccatcaacagtgtaaaagtgttcctatttctccaaatcctctccagcatctgttgtttcttgactttttaatgattgtcattctaattggcatgagaaggtatcttattgtggatttaatttgtatttctctaatgaccagtgatgatgagctttttttcatatgtttgttggccatgtaaatgtcttcttttgagaagtgtctgtttatagcctttgtgatggtgttgtttgtttttgtcttgtaaatttgtttaagttccttgtagactctagatattagaccgttgtcagagggatagattgcaaaaatgtttgccgattctgtaggttgcctgttccctctgatgatagtttattttgctgtgcagaagctctttagtttaattagatctcatttgtcaattttggcttttgctgcaattgcttttggtgttttagtcatgaagtctttgcccatgcctatgtcttgaatggtattgcctaggttttcttctagtgttcttatggttttgggttttacatttaagtctttaatccatcttgagttaatttttatataaggtgtaagaaaggggaccagtttttgttttctgcatatggatagcaagttttcccagtaccatttattaaatagggaatccttttcccattgcttgtttttgtcaggtttgtcaaagatcagatggttgtagatgtatggtgtatggtgttatttctgaagcctctgttctgttccattggtctatatatctgtcttggtaccagtaccatgctgttttggttactgtagctttgtagtatagtttgaagtcaggtagagtgatgcctccagtttttttttttttttttttgcttagggttgttttggctatacaagctcttttttgttccatataaaatgcaaagtagttttttctagttctgagaagaaagtcaatggtagcttgatttgaatagcattgaatctataaattactctaagcactgtggccattttcatgatattgattcttcctagccgtgagtatggaatgctttttcatttgtttgtgtcctctcttatttccttgagcagtggtttgtagttctccttgaagaaatccttcatgactgtttttaggagtattcctaggtattttattctctttgtagtgcttgtgaatgggagttcactcatgatttgactgtcagtttgtctattatcagtgtataagaatgcttgtgatttttgcccattgattttgtattcagagactttgctgaagttgcttatcagcttaaggagtttttgggctgagatgatggggttttccaaatatagaatcatgtcatctgcaaacagagacaacttgacgtcctctttttctatttcaatacactttatttctttctcttgcctgattgccctgggcagaacttccaatactatgttgaaaaggagtagtgagagagggcatccttgtcttgtgccagttttcaaagggagtgcttccagctttttcccattcagtatgatatgggctatggatttgtcataagttgcttttattattttgacatatgttccatcaatacctagtgaattgaaagtttttagcatgaaggcatgttgaattttatcaaaggccttttctgcatctattgagataatcatgtggtatttgtaattcgttctgtttatgtgatggattatgttcattgagttctgtatgttgaaccagccttgcatcctggggatgaagctggcctgattgtggtggataagctttttgatgtgtggttagattcagtttgccagtattttattgaatatttttgcatcgatgtccatcagggatattggcctgaaattttcttttttgttgtgtctctgccagtctttggtatcagcatgatgctggcctcataaagtgagttagggagaattccctctctttctgttgtttggaatagtttcacaaggaatggtaccagctcctctttgtacctctggtagaatttggctgcaaatctgtctggtcctgggcttgttttagttggtaggctattaattactgcctcaatttcagaacttgttattgttctattcagggatttgacttcttcctggtttagactggtgaggctgtatgtatccaggaatttatccacttctaggttttctagtttatttgtgttgagatgtttttatagtattttctgatggtagtttgtatttctgtgagatcagtggtgatatcctatttaacttttttcattgagtctatttgattattctctcttttcctttttattagcttggctagtggtctattttgttaaccttttctaaaaaccagctcctgcattcattgactttttttgaagggtgttttatgtctccatctctttcagttcagctctgatcttagttatttcttgtcttctgctagcttttgaatgtgtttgctcttgcttctccagttcttttaattgggatattagggtgtcaattttggatctttcctgctttctcttgtgggcatttagtgctataaatttccctctaaacactgctttagctgtgtctcagagatcctagtatgttgtctctttgttctcattggtttcaacaaactttgttatttctgccttaattttgttatttaacccagtagtcattcaggagcaggttattcagtttccatgtagttgaatggttttgagtgaatttcttaatcctgagttctaattgtattgcactgtggtctgagagactgtttgttatgatttccgttcttttgcgtttgctgaggagtgttttactcccagttatgtggttgattttagagtaagtgctatgtgctgtgagaagaatgtatatctgttgatttgggttggagagttctgtagatgtctattaggtctacttggtctagagatgagttcaaatcctgaataggcttgttaaatttctgtctcattgatctgtctaatactgatagtggaaagttaaagtctcccactattattatgtgggacctaagtctctttataggtctctaagaacttcttttatgaatctgggtgctcctgtattgggtgcatatatattagaatagttagctcttcttgtttcattggtccgtttaccattatgtagtggccttctttgtctcttttgatctttgttgttttaaagtctgttttatcagagactaggattgcaacccctgctgctttttgctttccatttgcttggcaaattttcctccatccctttatttgttttgagcctacgtgtgtctttgcatgtgacatgggtctccttaatataggacactgatggatcctgactctttatccaattttcccatctgtgtcttttaattggggcatttagcccatttacatttaaggttaatattgttatgtgtgaatttgatcctgtcatcatgatgctagctgtttatttttcacattagtttatgcagtttcttcatagagtcattagtctttatattttggtgtgtttttgcagtggctggtactgatttttcctttccatatttaagtcttccttcaggagctctggtaaggcaggcctggtggtgacaaaatcctcagcatttgcttgtctgtaaagattttatttctccttcacttatgaagcttagtttggctggatatgaaattccaggttaaaaattcttttctttaagaatgttgaatattggcccccactctcttctggtttgtagggtttctgccgagagatccactgttagtctgatgggcttccctttgtagataacctgtccgttctctctggctgccctacacattttttccttagtttcaaccttggagaatctgatgattatgtgtcttggggttcctcttctcgaggagtatgttagcgttgttttctatatttcctggatttgaatgttggcctgtcttgctaggttggggaagttctcctggataatatcctgaagagtgttttccaacttggttccattttccccatcacttttgggtaaaccaatcactgcttatttcattaagttgaccttcagtctctgatatcctttcttctgcttcatcaattcagctattgatacttctgtatgcttcacgaagttcttgtgctgtgtttttttttttttttttatatctccatcaggtcattaatgttcttctctaaactggttattctagttagcagctcctgtaaccttttatcaaggttcttagcttccatgcattgggttagaatatgagttcccctctagctgagaggagtttgttattatccatcttctgaagcctacttctgttaactcagcaaactccttctccatccagttttgtgcccttgctggagaggagttgcaatcatttggaggagaagaggcattctggtttttggatttttttttttttttttttgcatttttacgctagttttccttatcttcctagatgtatctacttttgatctttgaggctgatgaccattggatggggttttagtgtgggggtcttttatgttgatgttgatgttattactttctgtttgctagtttttcttccaacagtcagctccctcttctgcaggtctcctgcagtttggtggaggtccactccagaccctgtttgcctgggtatcaccagcagaggctgtggaacagcaaagattgctgcctgctccttcctatggaagccttgccccagaggggcactggcctgatgccagctggagctctcctgtatgaggtatctgtcaacccttgctgggagttctctcccagtcaagaggcatggggttcagggacccacttgaggaggcagtctgtcccttagcagagctcgaggactctgctgggagaatcctccttgtcaggatccactcttctgttcaaagctggcaggcaagaaggtttaaatccactgaagctttgcccacagttgctccttcccccaggtgctctgtcccagggagatgggagttttatctataagtccctgactggtgctgctgcctttctttcagagatgccctgccgagtggggaggaatttagaggcgtagtctggccacagctgctttgctgcgctgtggtgaattctgtccagtacaaatttcctggcctgcttagcactgtcaggggaaaactgcttactgaaacctcagtaatggcccctccccccagtaagctcggttgtcccaggttgacttcagattgctgtgctggcagcgaaaatttcaatctagtggttcctagcttgctgggcttcatgggagtgggacccactaagcgagaccacttggctccctggcttcagtcccctttgtaggggagtgaatggttctgtctcacttgggctccaggcacaaaacaaacaaacaaaacaacaacaacagcaacaaaaaactcctgtagctagcttggtgtctgcccaaacagctccccagtttggcgcttgcaacccagtgctctggcgatgtcagcacagaagggagtatcctgctccgtggattgcaaaaaccatggggaaagcataatatctgggctggatagcatagtccctcatggcttcccttggctgtgggaggaagatccctggcaatgcagaaacaccctgccttctgcattggtctcactgagagctgcagacaggagctgttcctattcaaccatcttgccagatctccatcttctcaaagttttactgtttctagtcttatgttgccatctttcatccattttgagttgatttttgtatatgataaaaaataagggttcacttttttcttttggttgtggacatccaattttctcagcaccattttttgaagaaactcatctttcttcattgagtatatttgggactcttattgaagatcagttagctgtatatattcatggatttatttctaggctttctagtttgttatgtagatctgtatctgttaatgtggtataatatacgtgttaatttttgtatgtgaaactatctttcattctaggaataaacttgccatgtcttctaggaaagaagtgatgctgagtctgaatacacagtaaaagccaagcaacactactggtcttgcaatctcaaaaggaagagtgagactttttacataatttaattattgaagatttcattggcaaaattaaaaacaaaaattctgctcaaaatgaagccaaaatattctgagtatttgcaaaacaatgttgatactatgagtggagttgttaatgttttgtgttcaaatacaatgtgtgaaacataaggaagctcagtaacttttgtgtggggtaacttttggattagaataataaatttcaatataagcccataaggttttatattattatttttcatagcttaaaaatcattgacatagaataattccaactaaagtacatattaaattcctggaaaataaattttgacttaacagggtaagttgtgaaaagacgttttgtcgcaggaaaaaggaaatcctccatttaaaaccctccatgctggaataaaggaggagtcccatcttttggtcattccacttcaggcttttgatataactaatcccttttcttcttctttcctgttttggcaagctttcggaaacaaaacaggcaacattttgtgatcataaatatcatagttgccacgcaggccagcaggaatgctatcacatccaaagagtggtactggatccaggtgaggttgtgggctgcgacccgaaggtgcttggctcctttatggcgcatgacaaactcaatccagaagactgctcgatccaggggcttcaccggttgatcatgatgaattcttgataatttcatgatattctctttatagctgaaggataaatataaagatatcaacattaaaagtaaatttattgcttaagcatatcaagtctatggatggtctttgaaaagcgccacacaagtgattcaaagtaagtgtcattgaattgacataaaatattaatgttttaatgtatgtcattacagaaagtttggtttttaaattggagttttatcactgacaaatacctttaaaaatgaaaaatggaattttcggtgggaaagttaatgtttttctagagcagaaaatattgtgagccattctaagtgctataagtaagatagtggaaatagaatctgggaatgatcattttgatatttttagttttttttttttttgagacaggcttttgctccattacacaggctgagtgcagtcacatgatcatggctcagtgcagcctttccgtttcggtctcaggtaatcctccacctcagcctcatgagaagctggggctacagctgcgcaccaccatgcctggctatattttttattttttacatttttagatatgaggtcttgctgtagtgcccatactcatctggaactcctgtggtctaatcattctgcctctgtctcccaaagtgttggccctacagacatgaaccactgtgcccagcccattttgacatatttaaagaagaattgtgtcacaactggtgaaatgtctcctaactagtttctcagcttctactctaatcttctgtcttctaccgtattttcctactagtagccagaacattttctaaattaatgtcaaattatgacagttgcctgtcaagatttccatctggtttcttgttacattaagaataaaatccaaatctgtctgtggtctagagaacgctacacagacacctacttgtcctaaccctttccccctgtacactttcttctagagacaatggccttctgttgttctttaaactcctgaaggtgttctcaccttagcccgtttacaccttttgttccccgtgtctctctcattgagcattctttcttgcaactacttgaggtttgcttctatttctttttgaggcttccccttaaatgatacctcttagagagtgttttcctggccacactataggcacccataggatttctctactgcttcgttcttattttgctatttgatttctggaactttaaaatatgttatatatcttccacaataaaagtttaagtatgaaatacataggataaatgtatatacgctatgtgactatctcaaaattttaagattatcttaaacattatccaaaagtgaaaacaccaatttatcacaaactgcatagaagaactctttcctcctgggccattttagtcactacttttatcctcaaagtaagtattaacctgaattctaatatcatagattatgtttatataattgaattaaataatacttattcatttctgtttttgtttagcagttgtttaattgcactggtgtagagtattcagttgattgacaaagaccacagatctcttcatttatgattaatggatatttgtgttgttaacattttttgatcttactaataattatggtattaagatatttatatattttattagatttacatacttattcatttttgttggatgtatacttggaagaatagttgatgagagaaaggcatatttataattagaattttttgactgaattttttaaaaaatattttttattttaaagaatcagagattgtttttagttatcattttctggatgatttataatttgattctagtatgactagaacatactatttttatgaatttgaatcttatacaatttacttagcatttttttatggcccagcatatggtcaattccagtaactatttcatacatataatctttttttttttttttttttgagacagagtctctctctgtcacccaggcttgagtatgacggagcgatcttggctgactgcaacttacgtctcctgggttcaagtgattctcatgcctcaacctcccaagtgtctgggactacaggtgctcatcccccacatctggctaagttttgtattactagtggacacaggatttcaccatgttggccaggctggtctcgaactcctgaccaaatgtgatcctcccaccttggcctcccaaagtgttggaattacaggtgtgagccaccacacccagtctccataaactcttttaaaaatgtttattttctgtctacacacacacaaccagagatatatgtatggatacatatatacagatatatgtgcaatatatatacacacacacacatataacacataggttacatttaattgtgtacttcaaatgttttatctccttaaataaaagttttcaaagatcattattttgtctactttggtctgtttaaatttaatgcgagtactggtaggttcacttttttgttgtgatctttgagatggagtctcgctctgtcaccaggctggagtgcagtggcactatctcagctcactgaaacctccgtctcccaggttcaagtgattctcctgcctcaaactcctgaggagctgggactacaggtgcacaccaccatgcctagctaatttttgtatttttagtagagacagggtttcactatgttggccaggagtatggtctcgatctcttgacctcgtgatctgccctcctcagccacccaaagtgctgggattacaggcttgagccaccacatctggtcggttcacattttttaaaaacagttttattttaagttccaggatacatacgcagaatgtgtgggtttgttacataggtatatgtgtgccatggtggtttgcagcacctatcaatctgtcatctagattttaagtccctcatgtattagctatttgtcctgatactctcactcccattccatgccccgaatggccccggtgtgttttgctcccctccctgagtccatgtattctcatttttcgactccctcttatgagtgagaacatgtggtgtttggttttctgttcctgtgttagtttgctgaggataatggctttgagtttcatccatgtccctgcaacagacataatctcattcctttttatggcacatagtatgccgccatactgtacatgcatcatattttctttatccagtctatcattgatgagtatttgtgttggttccatatctttgatattgtagatagtgctgcaatagacatacatgtgcatgtgtctttacagtagaatgatttatatgcctttgggtatatatcaagtaatgagattgctaggtcaaatggtgtttctggttctagatctttgaggaatcaccacattgttttccatgatggttgaactaacttacattcccaccaaaaatgtaaaagttttcctatatctccccagtttcaccagcatctgttgttttttgactttttaatcatctccattctgactggcatgagattgtatctcattgtggttttgatttgcatttctctaatgatcagtgatattgagcttttctcataagtgtgttggctgcataaatgtatttttttgagaagtgtctgtttatatcctttgcccactttttggtggtggtgttttttttcttgtaaatttgtttaagttacttgtagattctggatattggacctttgtcagagggatagattgcaaaaatgttccctcattctgtaggttgcctgtgccctctgatgatggtttattttgctgtgcagaagctctttagtttaatttgatcccatttgtcaactttggcttttattgtaattgcttttggtgtttgtgtcatgaaatttttgcccacgcctatgtcctgaatgatgttgcttaggttttcttccagggtttttatggttttgggttttacatttaagtctttaatccatcttgagttaatttttgtataaggtgtaaggcaggggtatagtttctgttttttgcatatggccagccagtttccccagcaccatttattaaatagggaatcctttcccattgcttgtttttgtcagttttgtcgaagatcagatggctgtagatgtgtggtgttatttctgaggcctctgttctgttccattggtctatatgtctgcttttgttccagtactatgctggtttggttactgtaaggtgtaaggaagggatccagttgcagttttctccatatggctaaccagtttttccaaaacaccatttattaaatagggaatccttcccctaattgcttgtttttgtcaggtttgtcaaagatcagatggttgtagatgtgtaatgttatttctgaggcgtatgttctgttccattggtcaatacatctttttggtaccagtaccattctgttttggttatgtagcctaatagtatagtttgacatcaggtagcgtgatgcctccagctttgttctttttgcttagggttgtcttggctatatgggctcttttttggttccatattaaatttaaagtagtttttttctagctctgtgaggaatgtcaatggtagtttgatgggaatagctttgaatatataaattactgtgggaagaagccaagatggccgaataagaacagctccagtctacagctcccagtgtgaatgacacagatgaggaatgatttctgcatttccaactgaggtactgggttcatctcccaggggactgtcagacagtgggtgcaggacagtgggtgcagcgcaccacgtgtgagccaaagcatggcgaggcattgcctcatcagggaagcacaaggggtctgtgaattcccttccctagccaaggataggggtaacagatggcacctggaaaattgggttactcccaccctaatactgcgcttttccaaaaggttttagcaaacggcacaccaggagattatatcgcgcacctggctcagagggtcctacgcccacggagcctcgctcattgctagcacagcagtctgagatcgaactgcaaggcagcagtgagactgggggaggggcgcctgccattcccatggattgaataggtaaacaaagcggcccagaagcttgaactgggtggagcccaccgcagctcaaggacgcctgcctgcctctgtagatccacctctgggggcagggcataaccaaacaaaaggcagcagaaacctctgcagtcttaaatgtccctgtctgacagctttgaaaagagtagtggttctcccagcacgcagcttgagatctgagaatggacagactgctactcaagtgggtcctgatccccgagtagcctgactgggaggcaccccccagtaggggcagactgacacctcacacagccgggtactcctctgagaaaacttccagaggaacaatcagacagcaacatttgctgttcactaatatccactgttctgcagtgtccgctgctgatacccaggcaaacaggatctgcagtggacctccagcaaactcgaacagacctgcagctgagggtcctgactgttagaaggaaaactaacaaacggaaaggacatccacaccaaaacccatttctacatcgccatcatcaaaaaccaaaggtagataaaaccacaaagatgggggaaaaaagagcagaaaaactggaaattataaaatcagaatgcctctcctcctccaaagaaatgcagctcctcaccagcaatggaacaaagctggatggagaatgactttgacgagttcagagaagaaggcttcagacgatcaaactactccggactaaaggaggaagttcgaaccgaaggcaaagaaggtaaaaaccttgaaaaaagattagatgaatggctaactagataaccaatgcagagaagtccttaaaggacctgatggagctgaaaaccatggcacgagaactatgtgatgaatgcacaagcctcagtagctgatttgatcaactggaagaaacggtatcagtgatggaagatgaaatgaatgaaatgaagcaagaagagaagtttagacaaaaaagaataaaaagaaatgaacaaagcctccaagaaatatgggactatgtgaaaagaccaaatctacatctgattggtgtacctgaaagtgacggggagaatggaaacaagttggaaaacactctgcaggttatcatccaggagagcttccccaatctagcaaggcaggctgacattcaaattcaagacatacagagaatgccataaagatactcctcaagaagagcaactccaagacacataattgttagattcaccaaagttgaaatgaaggaaaaaatgttaagtgcagcaagagagaaaggtcaggttacccacaaagggaagcccatcagactaacagctgatctcttggcagaaactctacaagccagaagagagtgggggccaatattcaacattcttaaagaaaagaatcttcaacccagaatttcatatccagccaaactaagcttcataagtgaaggagaaataaaataaaatctctaagcatttacagacaagcaaatgctgagagattttgtcaccaccaggcctgccctaaaagagctcctgaaggaagcactaaacatggaaaggaacaactggtaccagccactgcaaaaacatgccaaatgataaagaccactgaggctaggaaaaaacggcatcaactatcgagcaaaacaatcagctaacatcataatgacaggatcaaatttacacataacaatattaaccttaaatgtaaatgggttaaatgctagaattaaaagacacagactggcaaactggatcaagagtcaagacccatcactgtgctgtattcaggaaacccatctcatgtgcagagacacacataggctcaaaataaagggatggaggaagatctaccaagcaaatggaaagcaaaaaaaggcagggattacaatcctagtctctgataaaacagactttaaaccagcaaagatcaaaagagacaaggccattacataatggtaaagggatcaattcaacaagaagagctaactatcctaaatatacatgcacccagattcataaagcaagtccttagatacctacaaagagacttagactcccacacaataataatgggacactttaacaaaccaccgtcaacattagacagatcaacgagaaaaagttaacaaggatatccaagaattgaactcagctctgcacgaagaggacctaatagacatctacagaactctgcaccccaaatcaacagaatgtacattcttttcagcaccacaccacaccaactccaaaactgaccacatagttggaagtaaagcactcctcagcaaatgtaaaagaacagaaattataacaaactatctctcagaccacagtgcaatcaaactagaactcaggattaagaaactcactcaaaactgttcaactacatggaaactgaacaacctgcttctgaatgactactgggtacataatgaaatgaaggcagaattaaagatgttctttgaaaccaacgagaacaaagacacaacataccagaatctctgggacgcattcaaagcagtgtgtagatggaaatttatagcactaaatgcccacaagagaaagcaggaaacatctaaaattgacaccctaacgtcacaattaaaagaactagagaagcaagagcaaacacattcaaaagctagcagaaggcaagaaataactaaaatcagagcagaactgaaggaaatagagacacaaaaaactcttcaaaaaatcaatgaatccaagagctggttttttgaaaaggccaacaaaattgatagactgctagcaagactaataaagaagaaaagagagacgaatcaaatagatggaataaaaatgattaagggggtatcaccaccgattccagagaaatacaaactaccatcagagaatactataaacacctctacgcaaataaactagaaaatcaagaagaaatggataaattcctcgacacacacaccctcccaagactaaaccaggaagaagttgaatctctgaatagactaataacaggctctgaaattgaggcaataattaatagcttaccaaccaaaaaaagtccaggaccagatggattcacagctgaattctaccagaggtacaaggaggagctggtacccttccttctgaaactattccaatcaacagaaaaagagggaatcctccctaactcattttatgaggccaacatcatcctgataccaaagcctggcagggacacaagaaaaaaaagagaattgtagaccaatatccctgatgaacatcgatgcaaaaatcctcaataaaatactggcaaactgaatccagcagcacatcaaaaagcttatccaccttgaccaagtgggcttcatccctgggatgcaaggctagttcaacgtacacaaatcaatgaatgtaatccagcacataaacagaaccaatgacaaaaaccacatgattatctcaatagatgcagaaaagacctttgacaaaattcaacaacacttcatgctaaaaactctcaataaattaggtattgatggggagtatctccaaataataagagttatctatgacaaacccacagcaaatatcatgttgaatgggcaaaaggtggaagcattccctttgaagactggtacaagacagggatgccctctctcaccactcctattcaacacagtgttggatgttctggccaggagaataaggcaggataaggaaatacagggtattcaattaggaaaagaggaagtcaaattgtccctgtttgcagaagacatgattgtatatctagaaaacctgatcgtctgagccccaaatctccttaagctgataagcaacttcagcaaagtctcaggataaaaaatcaatgtgcaaaaatcacaagcattcttatacacccataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggaaacaaaccaatggaagaacgttccatgctcatgggtaggaagaatcaatatcgtgaaaacggccatactgcccaaggtaatttatagatccaatgccatccccatcaagctaccaatgactttcttcacagaattggaaaaaactacttgaattcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacacatctacaactatctgatctttgacaaaccttacaaaaacaagaaatggggaaaggattccctatttaataaatggtgctaggaaaactggctagccatatgtagaaagctgaaactggataccttccttacaccttatacaaaaattaattgaagatggattaaagacttacatgttagacctaaaaccataaaaactctagaagaaaacctaggcaataccattcaggacataggcatgggcaaggacttcatgactaaaacaccaaaagcaatggcaacaaaagccaaaattgacaaatgggatctcattaaactaaagagcttctgcacagcaaaggaaactaccatcagattgaacaggcaacctacagaatgggagaacatttttgcaatctactcatctgacaaagggctaatatccagaatctacaatgaactcaaacaaatttacaagaaaaaaacaaacaacctcatcagcttgtgggtgaaggaaatgaacagacacttctcaaaagaagacatttaggcagccaaaagacatatgaaaaaatgctcatcatcgctggccatcagagaaatgcaaatcaaaaccacaatgagataccatctcaccccagttagaatggcaatcattaaaaagtcaggaaaccacaggtgctggagaggatatggagaaataggaacacttttacactgttggtgggactgtaaactagttcaaccattgtggaagtcagtgtggcgattcctcagggatctagaactagaaatatcatttatctagcattcccattactgggtatatacccaaagggttataaatcatgcttctataaagacatgtgcacaagtatgtttatggaggcactattcacaatagcaaagacttggaaccaacccaaatgtccaacaatgatagactggattaagaaaatgtggcacacatacactatagaatactatgcagccataaaaaatgatgagttcatgtcctttgcagggacatggatgaagctggaaaccatcattcccagcaaactatcgcaaggacaaaaaaccaaacaccgcatgttctcactcataggtgggaattgaacaatgagaacacgaggacacaggaaggggaatatcacacaccggggcctgcttgggggtagcgggagtggggagggatagcattaggagatacacttaatgttaaatgacgagttaatgggtgcagcacaccaacatggcacatgtatacatatgtagcaaagctgcaccttgtgcacagataccctaaaacttaaagtataataaaaaaaattactttgggcagcatggccatttttacaattctgatttttttatccatgaggatggaatgtttttccatttgtttgtgtcctctcttaattccttcagcagggttttctatttctccttgaagaggtccttcacgtaccttgttaggcatattcctaggtattttattctctttgttgcaattgcaaatgggaatttattcgtgatttggctctgcttgtgtattgttggtgtataggaatacttgtaatttttgcatattgatttttctatccggaggctttgctgaagttgcttatcagcttaaggaattttagaactgagatgaaggggttttctaaatatagaattatgtcatctgcaaatagagacaatttaacttcttctctttctatttatagaataccctttatttctttttcttgcctgattgccctagttcacatttaaatccaccattttattctatatatttttgttttctaacctgttttctgtttctttgcttttttactttatttgaagtattttaaatcatttcttgtcttactaattttttggtaaagtgtttttaatgtattctcttagctggtaccaccttacatcataataatattggtaggattaatagactctgaattgatggtagctggtgtagtcacagcattttccatattatttcccttggattatggaaaactattacatatttattttatcaatattaaaaccttcatgtttcaaaaggcatcctccaaaaagtaaaaaaaaaaaaaaatctatctgcccatagtggaagaaaatatatgaaaatcgtatatttgataagggatagtatctataacatattaataattcttatgaatccataataaggtaaatagaaaaatgacaaaatgttcacaagattaaaatagaaattttatctaaggaagatgcatgaatgatcagtaagcacatgaaaagagggttaacatcttcagccataaggaaatgcaaatgaaaaccataatgagagaccactttacacacactagaaaggctgtaatagaaagacaggtgataacaagtgttgggaagagtgtgaagaaattagagccctcctatccagctggtggtaatgaaaaatgatgcaaatactttgaaaaacagtttagccattcttcataaacaacaatttcccatatgcctcagcaagtccactcctagcctctcctcaaaagaagtaaaaacatatttttacacagaaaatatgtataacaatattcgtaagtgccaaaattggaaagacctaaaatgtccatgccctgataaatgggtaattttggtataaacatatcaaagaatattatatagaaataaaaatgaatgagttctgatacatccaacaacataaataaaactaaaaataattatgctaagtgaaagaagtcgtttacaaaacactataaattgtatgatttcatttatataaaatatgtgaagagaataatctattgagaaacaaagtaagtcggtatttttctaggactggaggtgtattgggagtgacttcatgcattttgagtttaatttgagctcacaaaaatgttatttagggttgtggcttcgtaactatgtaaacatactaaatatatttagattttaaattttagtgaatgttatgctatgcaaattgtaactcattttcaaattgattaaaataatgataataataaaaataaatttttgagaaagaatagattcatactttcagaaattttaggtattgaattgaaatattttatcatatttctctagttacataatttctattgtgtattctatcattaaaaatatttaaaataattatgtacatatctttaatttttttgattttataattcattgcagtcattggtgacccattaaatctgtggggttgaaatgtaactttgaaataattgtctggtggaaaataagagcagattttacattggttaaatcacttcaatcccttcaaaattagtctcttaacaaagggttcaaactcatattcactgttgacaaaataatttgtaagtaccacctggtcacaaaattgtaatactcacatagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagattgcctcatagatgccattggttccaccatgagttataaaagctttggttttgggatgacctaaaagtggatgcattttaacaaagttattaattataaggcacaggaattgaataagaaatgcacaatataaggaacttaaagcaaaactgttccctaggtaacattatacccacaaaactgcattgaaattgttttcaaatttcagaggaagaagcacctacttctgctggaaaggtaagtgaaggctacatgaaaaggtggtggtctgtgtgtcttcacagtggaaacataaatttaaaagtttgccaggtgaacaaaatgaaaaaacatattcttaattaaaaaattaaaatgtgcaaaaaagaaaagaataagatttggtatacaagaacatagtctcttaagtagtataaattatgcagtcacatttatatatttaaaaaatatttaaatagttaaaatatttaaaatacttaaatttttttttaaaggcagcaaggagtagggtggaggtggtgctgaggaaggacaggttacacatcatcatgaaatgtgttatcactttatgataaagattggtgatttattcccacagaaaatagagtcactggtaatagaagaatgtctgttatttttcagtacctgttgaaataaccctgcagtaggggaaggaacagatgtaaagttgcagaaataagagacagaaaatccaggatgttatttaaaacctgtgagaggtaattacacctgaataaagagatttttattctgaccataaagaatgtgactgtatgtaacaaaatgccaactaccatagtgtattcttcttatactaagactagaaaataaatataaagtagttaaatttgatttttttttagttttccaataataaatgttaaatatgtttgttttatgttgaaatattatcacttctaattggctgttactaatatattcagtatttgttctccagagtcttaccaagaaggtcattctggggtaaccacttatacagtcgagtattggaacctaaagtatttggcttcttgccatcaaatctccatagaacctgttagggcaaggaaaatatcttgttcaatgaatagaactctaaaaatataacttgttagaattctgaagagattaataatcagttaatccatataaaagatgaagaaataagaagaagtgatgtcaagtaatgagaactactaaaagtctgaggtaagctgaatacccacatttaatatctttacttttataatcaatttggtatataaaaaaatgacatttctaacttaatagctagacacatgagagtgtgagaggaaaataaatcttggtgccccaaaatctatgctaaagggaaaagttaagctgctcagggcaaacctacttcccattctattcaaagtcagcccttggctcactgagataaatgcatatctaattgcctcatttggagaggctaatcagaaactcaaaggaattcagccatttgtctcctatctacctatgacctggaagccccttccatgcttcaagttgctctgcctttgtttctagttgtcccccatttctggactgaacaaatgtccatcttatataagttgattgatgtctcatgtatccctaaaatgtataaaaccaaactgtccccccaccaccttgggacacatgtcaccaggaccccctgaggctgtgtcatgggtgcacattttcaaccttggcaaaataaactttctaaattaactgagacctgcctcagatattcagggttcacattttggtaaccatgaagagactctgagtggaggttccctgacctttgataaatgtcctgtcagtgcttggtaccagcatgagctaactttatggctcaaacaaataagacaattggctgaggtctgggagcaacccctccagagaatccctgataccccaaaattcagtcaagaccaaaagtttattttgctgtacaactcctttttttttgttttttatttttttttggagttttacttgcttcctacaagaaaggcaatatttcctgtttccatgacaatggaaggcaggtaactctatggagtttgagctcactcccaggagggaggataaatttgaggtttctttcctacttctaggacgacagagggcagttttagcctgaaacccatccgtaggtaaatagctgaattggggttttgtcttggttaatgtttaacaactagctggacttaatttctccttaccattacagtgcttaatgatcacatttttgggagtattttttttgtacattccagtatttctcccatcagatttgacaaactttacctgacttgatcatatctgagtgagaattccaaattgtgggtaacaaagcctgtctaatttggtgaaaattcttcacagatgcaaaagagaaaacaaaacaaaacctaaaaaccatgctcttggtttctgtgtttgcttcctgtctttaaaaaaacaaatgttcttttgtttacttttcctccaccctatacctccttttgtcttttgccatttgtagtaccaaaaatctagagaaggcttctaatgatttgaactcttttaaagaattcagaacaaaggcaccactcacccctttgggggtgctctgttttctttgtggagtttcaagagttgtgggcagattttttcttaggtccaaagctctgttttcctatgttgaatgacctgatctctttggcttcgagattaccacagattaccttgtactgtgagaggattttaccttggcgtgtgtaatggcagacgagttacaaagtagagggtggctgagtacagtttactggaagtagtattgactgttgttatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgaaagactgagttttctcagctccaaagtgaaagggcatctgctcctcccaggcaaaaggcacccctaagcaactgggggccttgtgggagtgtcttgggtttgaccccctatgacatgcagtggtcctgcagggaaatccccaagaaaaattaacttttaaaaaaaggctagtccaggaaacacatatgagggcagatcacccagcattttgagccctctcagaggtcatacacctctggagggagaaactgagacacgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaagaagaagaatgatcccctgatatcgcctgtttggatttatgacacctctacttggcagagtttatgtaaaatgaaggtaatacggtctttgtgcacatatacattaagagccctaaggttgtcctacaaactgtagagttcctaagttctctcttttttaaaaattttcttttattcttgctttaaatttgcttttatttttctattaagttaaaaaccactgttttgattcaacaggtttttgtctgcaagctggtgatttttttttatctcatagctaaatttctgaagtaaaaaccacataatcttttgtgtgtgtgtaagtgtttgcatatatttaaaaggccattataatttctataattttatgtttaattggcaattaaatccattttattttccttctagcacaccaatttttttctctgtgtacattatgatgtaaattttgctatttgattttcacctgaatggtttcttttaatatgcaaatgtaagattatttagctcacaactgcctatggtgatcaagtattcatacagattacctattgaaacaggttatcaagaatttgaaagtctaatatggcaaagaggagtttttataaacctgtaagatgtacttctgttggcatgcttactacatctatgtatttatgtgttttgtacacaatgttttattactgaaaatatataaaagagctctaattaattggcttaagaaaataaaagtgcttgaattaaatactttgccagaaaaaaagactaattaaatgctttttcaagtttatgtaacttaaataaaatcttttataaataagataacaacaattattgataaagtatgataatattagaaatgcattaagacttgccagcatacatttttgtttgcatttattaatcaagaaatttcatacttattcttgccaaatactttaaggtgtcaaaatttgacataggggttacaaaactgtaaaccaagcccaaaacagaatgatcttcacttgtgtaatttttaataaataagacattaatattggtttaatgcaaatagctacaccttgaattaagtaagattatcataacttctcatcttgtggccttaagcaatctagtccacaggcattaagctttgttttgggaaaagactgttatcatttttatttcaaagctaaactataaactaagttcctccttaagttagtttggcctacacccagaaataaacacggagagcttggaggttaaaagcaagatggagttaggtcagatctttttcactgtctcagttataattttgcaatggcaattccataactttaaatgatgactaccacacttttcacaaatattctaggtaaatgactaaataattaggtaaatgtaatgggataaatacttatagacaaactcataatttagaatctaaggttatattaaattaaataatagatatttcattgtttgggtatttttaaaaaaaaatttgtaggaaaacattctttccaaaaaaaagtgcatcttttttaaaaaggtgaagaagtgttgtctaattcaaagcttatttaaaggttatgtataaaacaaggtaaaaggaaccaggaagtaagggagatgtaaagaaagttataaaaataaaaagttttttttttttttttttgtaaaaagcttgaagagaaataattttatatgagaaagaatcttgtgtggtaaatttagtcctagaataaaatgatcagttgtgtaagaaagaaggatgttcaggacaaaccagaaagtccaaacatatcatgaatgatctgtgtaagtcacaataagaagattaaaaaaacttttatatgatcaagttgtctataattaaagggaaattataatggtgtttctacagattgggcttgatgtaaaaaaagcacttatgcactaaataattggttagaacaataacattttcttaagggattgatttactcttaaaatattatgagttttttttttttaacccaaagtttaacttttcttgcatctcactgtttttggttttctctccccttttaaagggtgtgaaatagtaacactctccttcaactcattttcaactcatgtaagttttttcctcaagttctgtttgttgtggcataatgctaacagtgttttctaaaagctattcaactcctcaaggtccagggactatcacagaagaggtgggtgtgtgagattgaaagaactgatactaagagataaaataagttccgtttatgcataaattaatcattaatgtcaaagacacactaatgcaagaccaacatatgggcccctgtgtcagattaacaaggttttcttgaagcataaactgacttcttaataaagattataaacgttatgaaaggctgaggaaagttatatcttatggtcaagattagaattttatagattgttcatacaattttgaaaaacaaacttatttggcttcatgctgttttattagggcttattgtttggcaaattgagtctcctctctcaaagaatgaagatttttgcctttttttgaaatccttgagttactactttagtcaaatgaatgctttattttacctgtgatatcaagctttttaatcctttgatatttgacaaattttccaaaattatgtttttttctgacctaagtaatcctttaatttattagtttccctaaagtccaaaaatgacataatttggcttatttggtataaaaattatacagggaacattgtcaaacatgaaatggtgtttggtctttttgagctgtatttatataaatatgttattggcatgtgttccaaaattatgggaaactcctataattctgatatgacttagtgtgtacattatcagtaataattatatttgttatgttaagttattgtgtgccacagaggtaacaaatttccttgtccattgtgtctttgactgaggctgccctaaaactttttgtcatccacagacaattgttgtctgactttggtcctctttagaaggcgattttatactcagccatgaaattctaacaggtgctcttgaaaaaaagtttttgataattttggagattgtgacattagaatggaagaaaaactttcaggactcatggagaactaaaatgttcatgaatatcaagcagaacaggaattaactacatggactgaaataatagaaaactaaagtaatctttttgactttgcttaaaacattgctgatcctttgttttgttttgtttttttttttagagtgaaggaatctttctttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggaatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcataggtatttgatggtacaaatctatggcttgcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaatttttattactgtctacagtttggactgaattctaatttttcatggctacacgtcttcaaaatagtgtcttcaggttttttttcctccccttccacaatttttcctaatttggagtcactgtaaactaagctatgctttcataaagccctacaaattaagctagacaacttaaactccagaagaaaataacagcaaccaatttacatacataatccactttcatacctgcctactgatttatggacttcagagtaatgtggcctatattaattttaaaggattgttcttttgtttttgtttttctcacttcctccctttattttgtcttcacagtacatgagacttcagaacctgctaaaaatgaactttcctaataactcaggacctgcttaggaataaaccttccttgccattagagatcagatgaaaacctgagaccagagactcattttcttctaaaatgctttctccaaaagatttttttaaaatgtaaaatgaaaataaacctgggggccccaaagtcactaagcaaatcactgcctcccattctattcaaagacacccctctgctcactgagataaatgcatatctgattgcctcctttggagagcctaatcagaagctcaaaggaatgcctcttccctgcttcaagttggcaaaataaactttctaaatgtactgagacctgtatcagatatttggggttcacaagattatcaatgaaatattcaaatatataagaattgttaggcagtcttaattctagtaataaaaaagtagcaaattagtaataacctatatatttattttatatactttatactagctgtaaccttccaaatttaatataaatttattaatttttgagtgatatgggaagagtttacttatatccacttgtctactagtcataagttattttatgaatttgacatcattgattacaaaagactaaatacttaaactgcacatatggtgagaaataatgctacatatgtagtaaattcagactattatcagtattgctacttttgtaaatgctaacaatgtaggaaaaaggagcccattgacaattcatgattaacaatacagatgctgagaatgtagaaaattgtattttgctactttttgcttaactgatctttcacacttagatgatgcactacctagcattgacagccttgatatatggtcagctatagccagtcattaccatgtctagtaccaaactaaggtactgattttagatttcccaagcaatctttataaactggagtagaatttacaagtgttgtccttgtatttgatatgggagtgttaaagtaactctgtgttttcagcaaaaacttgcatagatcattcagagagggctatgcagataagaaagtaaaacgtaaattgaaaatacacaaagattgtaggtatattctatagattagaaaataagttcctaccatgtttatttatagttcctgctccttcctcaatgtggagaaggcactaatctgattcttagagcatagtctttgttgggccacatttaataatgcacatagtctaccctaaaagcaggattctatctccatcctttccattacatttttctgcttaagacattagcggcacccaagccagcagagcagacaagtttttctttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaattttaccgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactgttgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaagaaatgaaacaaagctatgacactgcagtaggaggagataatgctagaaaatattacacccagacactttatttataatattataattactaacataggttattggaaggtagctttacttggctttaattctatttttttttgtagttctactaaatctcttgtgtttatttggggtcattttattttatttttttctgttcagttcttttagttaggagtcattggagccattacatgactatgagcaatgaggaaaagttagttacaattagaatgattttatatctacatttatttagcttctttagctctctaaccctttatatttcacttagagtttcctagtcttaccccactacccctcacttcccccgacacccccacccccaaaaaacaccttaaaagctgaagtataagaatcattgacgttcatcagtctggtgttggggcttggaatttccgggaaatagttctgagaattccatttataatacagtattatatactatttagttacataattaagtgatcttatttctcagatcattgtttaggtatgactatgataccttttgtcctgaaatcacactgtgaaattgatgtgctatttataacttaccatgagggaccctcatcctcactttgctgtgtctcacagggggcacttgaaccacagtgggagaggtcaccaagcctttctccagtggagatctgctcaccccctagagtagctccctcacactatatgaagctcctggtaaatatgtgtttgcttcgaaatgaatgagaattattctgacttgtgtttcctgatgtgttcctgtttttaaacttaaatccattctctaatgccacatcagtcaatgtattctcacaccaaaaaaaaaaaaaaagaaaaagaaagagagaaagaggaaaagaaatgtagactcataagtttcccggatatcatatcaaaattgtatactcatctttttgttgctattgtcccttttgttctaaattctttttttctcagtaaaataatgaccaaccccttctatcataacaaatatactttctggtcctaatcattgggggaaatttctttataaaactgtttacgaataaaaaaggaaattctaaaatatgtcaattcagaccatatattggtatttttcaaaaatataattgaactttatgacatcttttatttttattttattttatttatttatttatttttgagatggagtcttgctctgtcacctaggctggagtgcaatgatgcaatcttggctcattgcgacctctgcctcccaggttcaagcaattctcctgcctcagcctcctgagtagctgggattacaggcacctgccaccacgcctggctaatttttctgtttttagtagagacaggtttcaccatcttggccagactggtcttgacctcctgacctcatgatccacctgcctcggcctcccaaagtggtgggattacaggcttgagccactgtgcccggtctgatatcagttttaattggagattcagtgtatggctattagagttaattcatgaggcatccaggaactcagtgtaattgcagttgcctgtagccacatttaatgtaacttcggtttaatgttttgtctcattcactgacaaaagtcttcttcatccaccaagtattgaagtaaaaaatcgtctgtttatagacagatcagcactgatctcattctgtgacgtctttatgaaagcaatggtaatagaagatcaatgtaagtagtcttgtaaaagtatgaaaatttaggaaaaaaatcatttttcccatatctctatctcaatttaaaatgtgtaccatttcattatggttttaattctatttatataactcaatgtacatatgtgatgtttatttagaaaattttttctcattgtatatgcctttttatcctacaaaaaaattgtgatcttgttctactcatcattctgttccttagtttccaactatacctgtactacagctgacagtgtaattaaacattgttttgaaaaaatggattgtaatggcttggtatgcgcattgtataagtttttaaccatttcttaatgtaagatatttgaattatttccagagttttttaacgaatatttgctactaatattgaatcttaccatcatgatttattctctgtacagtttcatgtgaatatattacaaaggcaataactatatgcagttttcaaacacttgatactttttggcaagagtcttattcttttgaaatatacaaacattatctgagaatctaatacataatggaaaagcaagcaaatttgtggcaacaattattttgtgtacaaaagaattagagaatcggtttcacaattatttacttagattcaagtctaccttttgcaggttaacaacaacagccagtgccgggcacggaggctcacacttgtaatcccagcactttggaaggttgaggcaagtggatcacctgaggtcaggagttcgagaccagcctggccaacatggcgaaactctgtctctactaaaaatacaaaaattatccggatgtgttggtgggtgcctgtaatcccagctacttgggagtctgaggcaggagaatcagaatcacttgaacctagagggtggaggttgcagtgagctgagatcatggtagtattagtaataatcactattgtactactagtcatttattccttgtcctccttattctcctattctcttccccctgctaatggcactatcactttcttttgatgtgagtgaggatttttttttgagaataagataagagtacacagaattaccttttaagctaaaatattaatgaagtgcctccacctttgcaatacaactttagctttccagcgtgttcaactgactgcccaaacttaaacatttatatttaaacaagcacacagagtatctgttctctaggattttgctaggaaaatcaatcattattaaatgaagactgatatcttaaatggctggcacatgttagctaatttaaaatattagaaataatgactaaaataataatcataatatcaacaatatttttggatcactggctatgtgtcagagacaacttaagtgttttatctgtggtaactacttttttccacacaacacaatatgaagttgtgattattattgtaaaagtagtcatgattgcctaaactcatgtaaaagttcctaaatattctttacattgtacaaagttgcctttctgtaatattacacattgagaacattgggattttttttgaaaggaaatctgatcatatctcttcatttcttaactcttttcagtagctctccattgtccttaatgggtatatcaaatttcatatatatatatatatatatattttttttttttgagacagagtctcactctgttgcccaggctgttgtgcaatagcatgatctcggctctctgcaacctctgcctcccgcgttcaagcgattctcctgcctcagcttcccgagtagctgctattagaggtgcctgccaacatgcctgactaatttttgtatttttagtagagacggggtttcaccatgctggccagtctggtctcaaactcctgacctcaggcgatccgcctgcctcggcctcccaaagtgctgggattacaggtgtaagccaccacgcccggcccatcattgacttttactcaaccttttcctgtaaactaaatttggagtcctgggaactgcccttactgcttttctacttttctgccttaatgcaagactttacttttttgtttgtttatttgtttgtttttgagacagagtctcactccgtcgcacaggctagagttcagtggtgtggtctcagctcactgcagcctctgcccccagactcaagcaagcctcctgcctcagcctcttaagtagctgggactatgagactacaggcacacaccagcatgcctggctattatttttatttttgttagagatgaggttttaccatgttgcccaggctggtctcaaactcctgagcccaagcaatcgtcccttctctgcctcccaaaattcagggattataggtgtgagccaccttgcctggcctctggttttctttttgggtctttctcatcccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgttaggcatgagggcgcagaaactgtgctacctttattctctgaaaatccagcacttacctgtggtttgcattaatcactctacaaatattttttgaagaaatgaaccatactatcttgtgggttgcacaatgaaggccttactttaaccaaccctgttttcaaaatctccctagtaaacctctttggtctttaatgataataacattcacatacttgtgatagtatagaaatatatgattttctaatggcaagtccttttttttgacctcccatattcccctcactctgagttaaacactctgaaagaaacatatccagccattccttctgaaaatgtcaagcaaacaaatgaaacaagaatatgttcaccttaggcaagggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttattttaatattgaatatgcaggtattttcctgaaaggacttggaataacatacctaaaaatatataaaatgtctgcacattgataatatatataaatacatttatataatataatacattatattaaatacattatattaaattaatgtatattaaataatattaaatacattatattaaattaatgtatttaatatatgttaatatattttaatttaatagtatttaatttttaatttttaatatttaataaagtttaatatttaatattaataaaattttattaattttattttattaataaaacattaataaagttaataaaattaaacaatatttaatatttaatttaatatttaatatttaatagttttaatttaatatttaaattatttaataaaataatttaatataatgtaaatacattatattaaatacatttatatagtcatcatttaatttttatgtattgcatatgttgctcatatgtatatataaggaaggcaaagtgttcagagagctgtaagaagaaatcacatctttaatgtaacatcagtatattcacaatcataaataattattaaaataagtcactaatatggtttgactgtccccacccaaatctcctctcatcttgaattataatccccataatccccatgtgtcgagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattgcccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaaatttttcagaatttattgacatagagatatgtgctcttccttattttggcccctattttctttgatggagagatgcagtttaataaaatatagattaaaacttagatgttcactttcaacaagatttcagtttttgaaggaaataattgtgaagttgttattgaaggaatgtataaatattagaaatctcaagttttaggcttctgtttctggagtagagccactatatttctcaactgtgaaggaatccttcttatatgaaaaacaaaatttaatttctaaatgaggaaactgaggtactcaggtacaagttcctcaatcctgcattgataatatttttagaaatatgtgtaaatataaaatttgtatgtctgccttcatgaagatgtttcttgaagtatctattgacttttttaaagatgaaaaaatgtatagcaaaatgatatgtgatggcttaaagaaatcataagtgttttacattgaaggtttatgactctcttggtgtcctatagcagtgatggcaccagggttctaactgattctataaggtcaacattctatatttttgagactcatagatcatcttacatttgcaattcataatttcccataaaaacactatcttctgacattatatttatataagcccaccttcaaaggcacaggaaaattagaacttaataaacaccaattggacacacgacttacctagaacttcactataaaactggtcccacttcttcagatcatatgcttgaaaccaaaagtcaaaataaagcatatatatcatattttttatcctctccatgaaaatcatttgatcacttaattctgacataacaacaggtacataggaaggagggaacagaaatcctccaccattcttctcaactgtgtagccaacagagaagcggagactgtacagaaagggtatgttaagtagctcagccagcagctcaccacagggattaacggcatctgccagaaggacatcaaattttgactcttgtagttttctcataagtttcttgttcaaaactgcatcttcacagagctttatattatagtcagaatattcccaacacaattcttgtagttgtgaaaaatatgaccaaaatgtattttttgaaatactatatgtccatctatcgaacattttcataaaaaaatcttccaaatcatttttagttaaagatgtaggataaacttctaatttaatagcagatgatttactggcattgacaagaatagaagccgaagatgtcaacacaatcacctcatgacccctctgaacaagctcttccaggattgtcttcatatttatccaatggctgtattctgtgggccacaccagcacctttccacaactcccagagctaaagtaacaactgagctgcatcagcagaaagactgacatccatttcagagacatcctggtcttatgcagtgcttcttttccagttgttgtttctttctgtcatttctcatacttatatctgaggaaaaatcaatcaagttaaaatataactgctaaaatttgagttgacctcatatttattttagtgtgtttggtgttcttttatatttacaattactctagtcaagcaataatttttatgacctagaatacgtaagtaacctgtcttatgtaattattttataatactgttaagaacagtggcaggtgagaggctcctgcctgttcggtgcccttgacatagagagaagaagtaattatacaactcaaacgccattttttaatatcgtggtgcaagtaatgtcttctaaaactttgttgacacataattcatataccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcaggtcaactgcaaggacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatataggggtagaggaagtagcagaaaggtactgggagctctctggatacccaagcagctcattcctgcctggcaccacagtgatcctttaggagggtggccagcggagcagggggttcaaagattcttctggggcctgaaagcttgaagggatgagtaactcctcccttctcaggcccagtcccaagatgcaaggctgcttgcatcagcagcgtgtgtcagcaagatagcagaagcaggaagagagccggccagaagacacctaccctggctggagacatgaacccttgaagatcaagaggccatccagatactacatagcagtcacgttagattgggacacttactctttacagagaactataaaaccactgtcccatcctcacttggggctgatgccattttaggcctcagcccacctgcacccaggcactcattaaaacagcacgctgctccgcactgcctcgtgttgtctgttggcatgctctcagggatcaaaccaattcaagaaccttatatctggtgccaaaacctgggtggggctcaggtctgtgtcccttgtggacctacccctccaccccagagagcaagccacagcaaccagacaaaggaaactcctcagcctccagttgcctctctgtgcatgtgtagcaggatgagccacagacaaaacttctcagacaccaagttgtagaaggaagggctttattcagctgggagcatcggcaagctactgccttaaaatccaagctcctcaagtgcgcaatttttgtcctttttaagggctcacaacactaaagatttcacatgaaatggtcgtgattgatttaagcaagcagtgggtatgtgacaggtgctgcatgcactgctggtcagagagaaacagaacagggcagggggttttacagtgttcttctgtacaatgtctggaatctctgaataacatcggtttctaagttatgagttgatttttaactactgggtttaggtcaggcaggcccaggcctggtttcaggcctggagccaggctgcctgtctttggttttacttctttgttgttttttcttaaaacaggtactgagcataaaacaatataaaataatctgagagggtccttctcttccttcattccccccttttgagactctcactttttattagtgggagttctcactcatttttttacttatgtctttttgtggaatagactgatagtgattcatatagtacagttgtgctgaagcattttgttgaactaaggtagcgatgaagctttttatcatttgaagaagtacaggtagcaaacaagggagcagtaagcaggtttttataattattgtaactcctattataagagttttaaatttttctagtgctgggaaccactttctaaacatggcttcagggttgaatccgtgctacacttgcacaggtacatgtgccagttttgtcatatttttaactatgtctttaataacttgcctgattatctatgtgtagacagtaattagtaaggttaaatttttcacaaactcctccttcagctgctagcaagtagtcaagagctagtctattttgatagattgcatttctcatctgagtctcttgccgggcaagaacggtcaaggcttgaccggttttattagtaaaaatttctaaaacagcttgtaaccatatgattcggttgagcatgtagatgggggtccaatatcctcatgagccatcttgtgcctaagtggcgggtccatagtattgtatgatttttttcagggggctatttatcatcttttcctatggctatgcttcatttttttgttcccaggaagcatagactgggaagcctagaagttcatgtttttatgggcagtaagaagaaagaaggcttaatggtgcgaattacacagctacctgtctactgatcaggcagcttagcataagctttgtgtccacatatatccagtataatccggtgggggccgtccagtcccagtggaattctgggtgggcccaaacagtctgcaactttggaaatttactgaatggatttctttctgtgtaattggaactccaccatgtgactgtttttgtggtactattatagagcttttgtctaagacagctaagctgccttacaggatgagtgaatccttttccttctttagctatgcaatactgtctaataattgagacttttagaacctagagatgatcagggtgattcttttgggctgggaattcatcaggaaatgggtctgtaggaactaattcttgggcttcctatggccattgatctactgttatggttcctccacaaacataatatgaggtgacttgtagagactgggctacgtgttaggctaattgcaaaaagaaatttttagtttttcctggaatctcaggtactggcacatttagttcatcatagaaagtctgaaacactggttctggagagcgtttttgaacctctccttttattaggatgcttacattaggatctagtccctttttatccatgtctaatgatatatatttttcttttattttactttgggtctgaggggtttgtgattatcaattctaaaaggttgtagctcctattcatgcaagaggggctgagttttcctttttggagtcaaacacgatcttttttattttccttttaagtagtctgaatgacacgagaccagtattgacacatctcacataaatatgatttttgacagatatacttattttttttactgtgtaactttcttttttaatttagagaatcacatcctgtttcatgctgcttactattaatagcggcacaagtgtcaaattttaaggttacattttgaggagctctgtttttttcggttctacctattaccttacttgtgtcacatagaaaaggagcagtccttaattttattttaaaaactgtgatcatgggaggcttaaaattgttcataacacacatcaggttggttatttcctgggctacataccttggatagaatagcattatacaaacaatttgttgttgtttttgttgctatttaatttttttagagtcctcgggcgtccgtgatattagtgttagtcagttttgttgtgagtgttagaaagagggcatatagaaccaggaagctgataagaaagacgattatgagggcgtgatcatggaaggcaattagctcttttataataaccataaagtaattagctcttttataataactataaagtaataggactgtagcaatcttttgttccacctcagtgacttgatgtatatactggaaacagttcttagtctgaggaaggtcagttgaagtccttcctgtacaagtccaaattctgaggaaaatgagtcctgcgatgagtctcctcatgcttcagccatgcgtggaccagtcagcttctgggtgtgactggagcagtgtttgttgtcttcttcagagtcattttgcagggattggtgaagctgctcccatccacgtacagctcccagtctactgatgtacagttatgtttaactgggctctctgataataggagtaagatagtgagcttagggtgttgcaaacttcaatggttatgtggggattttcacaatgcaagctttggtatctagttagtctatcatttattagctaatgatgtcctttggtatttattaaaattaccacagcatggggagactttatgtttaggtttttcctaagagttagcttatttgcttcttgtgttaacagggctgttgctgccagggcccttggacatgggggccagcctttggaaaccccgtctagttgttttgagagacaggccattggccttggccaggaacctccagtctgggttaaaactccaactgccatttttttctctttctgacacatagagtgtgaagagttttgtcaggtcaggtagcctcagggctggggccgacatgagttttttttttttttttaactcatgaaaagctctttgctgttggttgtaatagatgtagtttatctaatctacatttttattgactgttatctactaaaatattgacttaaatcttgtaactatttgatttcaagctttaaattgatctggtattccttgcagggcttcgattgcatctaaatagatgtgagagttgaaagacttataaggggctcctctcactttacgatgtgttattattattttttccttcctctggttgatgaaatgccagggtgaaagggatagcccaatggactaaggcacaaatgccactctagttatttggcagagtgcctagtaaaggtccaccacaatactaccacacatctgctcagggatgaacaagggctgattgattgataagctcttgaaaattcttaagctcactgcatccttttaggtctccaaggaatgctaagtttcctccctgccgtgagagacaggaagtgaacttagtgttgagagacagaagctggatggcccttgggggctgactggcagggacttcaggatatagcagagagagcttggcatgacttattactccaggctgtagaatcctggaaaagagctaccatcaggcccacacctggtgaactggaggaccaccgtagtgggaaggggacaattagggcctctggcctgccatgtgcacaagcataacaattgcttttgtttattgtgtagttggaatatttgatccatttcaaccaggcatttgtagcttgatatactgtcttaattgctaaagtttgttttaagtctttaacttttatgatcctctagtaaaatgaatatttccattagcactaatttttattagtttttagaccaaagaaagctaaacatcattttatatttaatgtttcttgtatgatttttataccagataagctaaattttacttttatattagtgtgttattaatattaaacttaattttaataaaaccttgtagacatatttatccaatttttcatagttgaccataaggtaagattttatagactctgtttaaccttttacaatttttgttaaagagcaggttgatgctttaaggaaaaaacctgttgcatttttactttcatgtctagttcacagaaaaactggataatacttttttaactttagctaataagtttacacacagaattttctttaaattaacattttaaaacttgcttgaacttttcaaacaataattcttttttgactttttaatgtaggtaaaaatccacattcttatgcctccttataatcttctcattaaagttatattttacttttttatacacctgcacataaactgtttcttcaatagcactcaggaggccttattacttttaaattatgcaacattttttgcataaaattttttataactttttttcacgactttcgccaacaatttttcaacatgtctcaactttctgacttattacaaacatttttttcttctctttaaacaacaagttaatttatttcaggacaagaatttaccatataacactctttttacataaattttacctcctccccccccttttttttttgaagataaccattccttttttttaaaaagtgaactttctttatgtctttggactagactgtctaaggccacaagattagaagttaccataatatgtgttacactgtcaacttttagcaaacttcgcttttgttgaaaaccttgtaagtttgaaatttcaattatcctttgctattaataagaccttgtttagtctaaatttacttagaattggtatagatggccttttttttttttttctctgctggtctttccttgcctctgccagctgcttatgctgctgttctcttaactattgtgagggggggtggggggaaggggtctaaaaccagctgtaactgtctatgtacagaacctggtctgggtgccttggcttacaggttaccttgtgccataccttagaaactaaaaagacctatctaggcttccttctgatggctaacctacctctaatgctggccaatctatttcacacaaagttctaagttttcctggagtcatagtgactccatagtctctattaaatcctttcttgaaattcattatcatagttcccagtgcagtgggcttactttgtgcctgatctatgtttttttgagacaaaacaccatgctcacagcacacacacaccacaaaacaaagaacgggtaaaagggcacacacaaacatttcagtttacaccaaaccaaaatcaaaaccaaaatcagagtatccagaaatccaagccaggtcaaaaaccaaaaccaaagtatccagcaattcaagtcaagtcaaaaccagatcaaaagtgccaatacaggcacaccgtgggtgatcaggctatgctacacttccattcaggtggagtggggcaagttcaaaagactagtcctaccaagtctagccaagtcaaaaccagaacaaaggtgccaacacaggcacaccgtgggtgaccaggccatgcttctactcaggtggagtgggacaagttcaaaagactagtcttaccaagttccagatgtccagactccaagtgccagttccttcccggtgttcagccactgtgttaatcctccacgggggcctgctacgtgttgatctggtgaggtgttccactggggcaatttcctacccaggagcgctctttggatctcatcactcaggctgcccggagtaccccacagggatgctccacagggcaggcttaagccacctaaggggctgcctcagccttccgtcagtcaccttgcttctgggtcagggagccaagaaatgtagcaggacgagccacagacaaaacctctcagacatcgagttgtagaaggaagggctttattcagctgggaacattggcaagatactgccttaaaatctgagctccccgagtgcacaatttctgtcctttttaagggctcactacactaaagatttcacatgaaagggtcgtgattgatttgagcaagcagtgggtatgtgacaggggctgcatgcactggtggtcagagagaaacagaacagggcagggagtttcacaatgttcttctatacatgtctggaatctatgaataacattggtttctaagttatgagttgagttttaactactaagtttaggccaggcaggcccaggcatagtttcagtcctggcgtttgggctgcctgtctttggttttacttccttgttgttttttcttaaacatgtactgagtgaaaaacaatataaaataatatgagaaggtctttctcttccttcacatgcacattggtcactgatctcgcctactgttaggcttccctgggagcccagttaacaggggaaaatctgcatgacctctcttggtttctcctgtcccaaaatccaacactgatccaagaaggctccagtatgtgccaggcactccctgatcatctggtcttagggggacgcctctaagccatttgattccgttccaggaaccaaaaaggcagaggtgataatagctccttttattgtcttcctccagctgtccaggacagtcttctttttccctgttctccagagcctaccctttgatatggaaaactccccatcctccattccaaaaaacagccctccagactgcctcataaaaaatctgcaaaccttaggcctcaggcaagatacccaccctaagcgccttgtcttttttatacaataaaacctggccgcagtatgaattagataacgggtccaaatggccagcaaatgaaacacttgactttacaattttaactggttaaagcaattattgccgatgactggaaaaatggggagaaattccttgttccaggcctttttgcactcagatcacaacctgacttctgcaattcttgcttacctgttcaaatccttcattctcaccgccctcataacctttctcctcctgaccctacctctttttccttgttggatccagcagactgctgtccacccctcccagcccctacccccacgtctcaaccatcttctataactccccaagctttctcattgtcttcgcagtcaccatcttcccagccaccatcttcccagccggcatcacctccaaaagtacccacttctttttctacaccgtcctctcctcaggaaaactctagcattgcctgtactcagtctccttcctcactgccctctcctgaagcctgtaaacccatcaagccaccttacacccctatgtatcctccactgcctgtcaactcaacccgccttcccccttcaaaccctcagcaggaaccccttctggcttctttcttctctcctgtccataccagcttgggcaccatctttggcccacgctgcacccatacttcagtgcgggtgctagaatgcccccttcaggaagtagcaggaactgaaggtattgttagagttcatgttcccttctccttcactgatctctcaaactaacaagactcagttcatttccagaagaccctacctcttatattagggagtttcagtaccttacccagtcttatgcactaacctggtatgacctctacttatcctgtcttccaccctcaccttctacttatcctctcttccaccctcaccccagaagacagggaccatatttggaccctggttcaggagcatgctaatacaattcatcatcaagctcctgcccagcctactggcacggaggcagtccccaaccaggagccccaccaggattatcaagacagggcctctggacactgccatcaagaccacatgattgtgtatctccttgcaggactcaaaaagggtgcccataaagtggtaaactataaaaacctttcagaaatcacccaaggtcctgacagaaacccagccttttttctctcttgtttaactgaagccatgagaaaatataccaacctagacccagccaacccagaaggaatcactattttaaacctttggttcctcatccaatctacccctgatatttggtgcaagattcagaagcttgacaatggccctgaaaccccacaatgacaccttcttaatttagtcttcaaagtctttaacagttataacgaggaaagtaaaagaaaaaaaaaaaagacagagtttcaaatgcttgcctccaccatcacgggccctgcaggcccacaggctgcagctccacacagatgcctcctagcaatccacctccccctggcacctgtttcaagtgtggcaatgaaggccactggtccaggcaatgcccaaacccaggtaagcccaccaggctgtgccctctctgcggaggaccccactggaagtcagactgtgaggtgccccagcaaggaccgcccccatccctgccccagccggccaaaacctcctactaggatctcatcagccttgccgctgaagactgacagtgccctggaacagatgccccagcaactaccattgcttcatctgagccaaggataaccttgatgttggcagataggccagtattttttttttaattaatattggggcaacctactctgctttacctaaattttcaggacccacccagtcctcccaagtctctgttgtgggaatcaatggacaagtctccaaaccccaagacccccctccacttttctgctccctgcacaccttttccttcagtcactctttcttagtcctgccttcatgcccagctctgctcctaggcagagatattctttcaaaactccacactactctccacttccacattccccatagtacccaacacatcaacccagacccctccaaggcttctaacaggcttctaactttcttctactcctccgacctcccaccctgaagcatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaatctctttgcctttacctgggagaaccccgacacccacctttcaggtcagctcacctcgtgtgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctctcttttaaacctcttggcagaacaggggtatcaggtctcccctaagaaagcccaaatatgcaccccccagtcacctatctaggcctagctctcactcctgaacgcaagggctcacaacagaccacatattccctccttcagtccctcccgcctccacaaactaagcaagaaattctctcttttccaggattagcgggatattttaggctctgggtttcctccttcgctttacttgccaaaaaattatacgaagctgttaaagtccctctctatgagcctttaaaacctgcacagcctattacccaacctttccatctactccaaaagtctctcatctcagcccccatcctcactctcccagacttcaccaaacctttctccctttatactgatgaatggcgtggagttgcactaggtgttctaacccagtctaaggggcccacccggccaggttgttgcctacctccctaaagagcttgagaccacagttcttggatggcctgcctgcccctgagcattggtggcagctgctctcctcactcttaaaagcctaatactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacctgtccatgctcttacctgaagctacaactgcccaagactctacactcttctgtgtgaatactgttcaaacctttcttataccttttccatacctaacagaccaatcccttccagatgcctcctttatttggtttgtacatggcagctccttcctacatcaaggacactgacatgggggctatgctatagtgtcaccccccaacactattgaagccaatccgctcctcttaggcaccacctcccaaaaagctgaattcaatgccctcactccagctctcactctagcatccggaaaacagatcaatttattcaaattctcattatgcgctccacgtagtgcactcacactcatccatctggaaagaacggggtttcctaactgcaaacaatactcctgtcataagacaagtcttctagtccttgtctgtactttctctgggtaggtagaagaattcccaacaacttcagaaggtgcaactgtcatcgcacaaactcatcatgcatacctgcaattccccgttttggactcccaacatccatccagtctgataacagtcctgccttcatcagccaaattacccgaggcatctctacatccttaagaataaagtaagctctccacacaccctacaggcctcaatcttcaggcgaagttagaaaaattaactctgtctttaaagcccaactcaccaagctggctgtagaaacccaacagtcgtggacaaaaaaaatctccctttcgccctcataagactttgcacaacaccaaaagcacactctttttatagtccctttgaaatcatgtatgaccaaaattttgtcttggggcctccacccttaccagactctgagccactcagaaattaccacccctccttaatccagacatggtctttcatttgtgaagcagcaaatgagccatgcctctccctgtcgacacctcctggtcctctcaacataactgacttgcaggcacagacatgtttccagacaatacagatggtgctcctgctacagcgacatggtggataccaacctgtctctcaagaataccccaaaaattaagttttttttttccaaggtgcccactccaatccctgtgtcatgcctgaagtagttactgagaaagtcaccccttttccctttattctataaccaaataaacaggaagattctccctggggcctgaaagcttgaagggatgagtaactcctcctctcaggcccagttccaagatgcaaagccatttgtgtcaacagcttgcatcagaaagatagcagaagcaggaagagagccaactggaagacacctaccctggctggaagacacatacccctgaagatcaagaaagagaccgtctgggtactacatagcagtcacatcagactgggacacttactgtttacagaggactacaaaacccctgtcccatcctcacttggggctgacgcccctttaggccctagcccacctgcacccaggtgctcattaaaacagcatgttgctccacaccacctcgtggtttctgttggcatgctctcagggtttgaaccgatacaagaacattacaggggtaaaactccacagtaagagggacttctctagctgaactttgtaacaatttgaacaggcaagaagcctcatggccagaaattgggggagggcatgaatctagcttgcagacttcacaggcaggggaagaactaaagcccttttctttgcagctgggaggtggaaaatctcaggcaaatattcaagtccaactctccctcctccttgaaaaagactcgggactattgcaggggccacggtggaagtgggagtggcccttcagtgtgcatgggaggtgggttagaactgagactgctggctttcccacacttccctgacgacctcatgactcagcagaggcagccaaaatccacctaggtacacaactccagtgacctgagaatctcacctccatccccagcagtagccaaagcaaggccctcccaaggaaggtctgagctcaaacacgcctggacctggcccacctggtggtccttccctacccccctggtagcagaagacagaggacctacaatcttgggagttgtagggccgtgaccaccaccagtccctctccacaatactacagctgatgctttctggaaagtaccacctcctggcagaaggccaatcagcagaaaatagagcattaagccaccaaagctaaggacccccacagagtcctttgcaccctccacctgaacaggcactggtatccacagctgagagatccatagatatttcatatcacaggactctgcagacaacccccagtaccagcctggagctggatagacttgctgggtggctagacccagaagagagacaacaatcactgtaatttggctcacaggaagccacatccacaaaaaaaggggagagtaccacaacaagggaacaccccataggacaaaaaaatctgaacaacagtcttcagccctagaccttccctctgacagagcctacacaaatgagaaggaaccagaaaaccaacctgggaatatgataaaacaaagctcgttaataccccccccaaaaatcacactagttcaccagtaacagacctaaaccaagaagtccctgatttacctgaaaaagaattcaggaggttagttatgaagctaatcagggagggaacagagaaaggcaaagcccaatgcaaggaaatccaaaacataatacaagaagtgaggagagaaatattcaatgaaatagatagctgaaagacaaaacaataaaaaattcaggaaactttggacacacttttagaaatgcaaaatgctcaggaaagtctcagcaatataatagaacagatagatgaaagaaattcagagttcaaagacaaggtcttcaattaacttgttccaataaagaaaaagaaaaaagaaaaagaaaatatgaacaaagtctccaagaagtctaagattacgttaaataaccaaatctaacagtaatcggtattcctgaggaagaagacaattcgaaaagtttggaaacatatttgggagaataattgaggaaaacttccccagtcttgctagagacctatacaagaagcacaaagaacacctgggaaattcatcacaaaaagatcttcacctaggcacattttcatcaggttattcaaagttaagatgaaggaaagaagctgggcatattggctcacgcctgtaatcccagacctgatcaggtggtcggaggtgggtggacaacctgaagtcaggagttcgagaccagcctgaccaacatggagaaaccctgtctctactaaaaatacaaaactttgctgggtgcggtggcacatgcctctaatcccagctactcgggaggctgaggcaggagaatcacttgaacccaagaggtagaggttgtggtgagatcatgccattgcactctaacctgggcaacaagagtgaaactccatctcaaaataaaaaaaaaaaaaagatgaaggaaagaatcttaagagttgtgagagagaagcaccaggtaacctacaaaggacaacctatttgattaacagcagatttctcagcagaaaccctataagctagaaaggattagggccctatcttcagcctcttcaaacaaacaattatcagccaagaattttgtatccagtgaaactaagcatcatatatgaagggaagatagccgttttcagacaaacaaatgctgacagaattcgccattaccaagctaccactacaagaactgttaaaggaactctaaatcttgaaacaaattctggaaacacatcaaaacagaatatctttaaaacataaatcacacaggacccaaaagatcattcaaggctgctatgaacacctttatgcacataaactagaaacttagaagagatggataaatttctggaaaaatacaagcctcctaacttgaatcaggaagaattaaatacactgaacataccaataagaagcagcaaggttgaaatggtaatttaaaaattaccaacaacaaaaagtccaggaccagacagattcacagcagaattctaccagacattcaaagaagaattggcaccaatccttttgacattattccacaagacagagaaaagaggaaccctccctaattcattctatgaagccagcatctccctaaaaccaaaaccaaaaaaggacacaaccaaaaaaggaaactacagacctatatccttaatgaacatagatgctaaaatccttaacatgatactagctaaccgaatccaacaacatatcaaaaagataatccaccgtgataacgtgagttttacaccagggatgcagggatggtttaacatacacaagtcaatatatgtgatacatcacataaacagaattaaaaacaaacatcacatgatcatctcaatagatgcagaaaaagtgtttgacaaaatccagcatcattttatgattaaaactctcagcaaaactgacatacaggggaataccttaatataataaaagccatctatgacaaacccacagccaacgtaatactgaatgggaaaaagttgaaagcgttccctctgagaaagggaagaagacaaggatgcccactctcaccactcctcttcaacatagtactagaaatcctagccagagcaatcagaaaagagaaagaaataaaggacatccaaatcagtaaagaagaagtcaaactgtccctgtttgctaacaatatcattgtttaccttgaaaatcctaaggactcctccagaaagcacctagaactggtaaaggaattccacaaagtgtccagatgcaagattaatgtacacaaatgagtagatcttctatacaccaaaggcaaccaagcagagaatcaaatcaagaactcaaccccttttacaatagctgcaaaaaagtaaagtagagtaaaatacttaggaatatacctaacaaaggagtcaaaagacctgtctacaaggaaaactacaaatcactgctgaaagaaatcatagatgacacaaacagatggaaaaacatcccatgctcatggatgggtagaatcaatattgtgaaaatgatcatactgccaaaagcaatctacaaattcaatgcaatctccatcaaaataccacgatcattcttcacagagttagaataaacaattctaaaattcatatggaaccaaaaaagggcccacacagccaaagcaagactaagcaaaaagaacaaatctggagccatcacactacttgatttcaaactgtactctagggccatagtcaccaaaacagagtggtactggtataaaaacaggcacatagatgaatggaacagaatagagaaccccaaaacaacacaaatacttacagccaactgatctttgatgaagtaaacggaaacataaagtggggaaaggacacccttttcaacaaatggtactgggataattggctagccacatgtaggagaatgaaactggatccttatctctcaccttatacaacaatcacctcaaaatggattaaagacttaaacctaagacctgaaactgtaactctagaaggtaacattgggaaaacccttctagacgttggcttaggcaaggatttcatgaccaaaaacccaaaagaaaagcagtaaaaccaaagctaaatagctgggatctaattaaactaacttttgcacagcaaaaggagcaggcagcagagtaaacagacaacccacagagtgggagaaaatcttctcaatctatacatctgacaaagtactaatatccaggatctacaacgaattcaaacaaatcagtaagaaaaaaaaaaccccaataaaaagtgggctaaggacatgaatagacaattctcaaaataagtatacaaatgaccaagaaacatatgaaaaaagtgctcgacatcgctaatgatcaggcacatgcaaatcaaaaccacaatgcaatactaccttactccttcaagaatggccatagtaaaaaaatcaaaatacagtagatgttggcatggatgcagtgatcagggaacacttctacactgctggtgagagtgtaaactagtacagccactatggaaaacagtgtgacgattccttaaagaactaaaagaactaccatttgatctggcaatcccacttctgggtatttacccagaggaaaagaagtcattattcaaaaaagatacttgcacatgcatgtttatagtagcacaattcacaactacaaaattatggaaccaacccaaatgtccatcagtcaatgagtggataaagaaactggtatatccatatgatggaatattactcagccataaaaattaatgaattagtagcatttgcaatgatctgaatgagattggagattattattttaagtgaagtaactcaggagtggaaaaccaaacatcatctgttctcaatgataatgtgggagctaagctatgaggacacaaaggcataagaatgttacaatggattttagggacttgagcagaagagtgtgaggaagcaagggataaacgacaacatatgtggtacagtatgtactgcttgggtgatgggtgcaccaggatttcacaaatcaccactaaagaacttatgtaaccaaataccgcctgcacgccaaaaacctatggaaaaataaaaaaaatttaaaaaatgaaatcatacaatgtatggtctttagtgagtggcttcttgtgcttagcataatgtattaaaggttcacccatggaagagtgtatataaggacttcatttctttctattgtcaaatagtactccaaagtgcatatatactcattttatttgttcatttatcagttggtagacatagattttttccatttttgatgattatgaataatattgattaacatttatgtacaagttttctgtggacatatttttatttctcttgggtgtatatctagaagtggaattactggattacatggtaaatgtatatgtaaccttttgaggaattgctaactgtttttcacagtggcagaattattttccattctcaccaccaatgcatgatggctttaatgtctccataaccttgtcaatggttgttatcctatgttttttgattacagccagtgtgagtgaagtgatatctcattatgatttatatttccttcatatctaacaatattgagcattcttatgtgctaatttcccattatatattttcttagaaaaatttctattttgatactttgcccattttgattatttgtcctccttttatggacttatgcatttaataaatttttgacataagtcccttgtcacatatatgatatccaagtatattatcttatttttttggttgtctttttactttcttaatgatgtccattgaaacacaaaaatattaattttgatgaaatcctatgaatcaacttgaattgggtcacttttatttttagtgtcatatctactaaactatccccaaatgcaaaatcatggacattagcaaccatgtttcattattagagttttacagttctattgcttacatttagcttttaacttattttgagttaatttttgtaagtggtttgaggtagggggccaacctctattatttcgtatatggataatcagttttctcaattacatttgttgaataatctattctttgactcattaaattgggcactttggtcaaaaaccataaatgcgtgagtatattcctagattccaaaatctattacactgatttgtatgcctaccttatgtctgtatcacactctcttgattattgtatattggtatttgtctttaaaagcagaaagtgtaagccttccaactttgttttttattttaaattgtttcagctatttttttttcttctagcttttttttttttttttttttttttttaaggcaggggtctcactacatttcccaggctgaactagaagtcctgggctccagcaatcaatgaatttcagccacctgagtagctggggctacaggtgcatgccactacatctaaattgtttcagttattactgtctcctacatatctacatacattttagaatcagctagtcaatttatgcaagaagttatctgggattttaatagggattgaattgaatctgcataacaatttggggagcagagtatgggcattgtcacaatattaggtgtttcaatacatgagtataagatgccttttcatttatttagatatcatttaatttatttccataatgttttgtagatttcacagggcaagttttactctccttttgttaaatttattgatggccaggcgtggtgactcacacctgtaatcccagcactttgggaggcctaggtgggcagatcacaaggtcaggggttcgagatcagcccgacctacatggtgaaaccccgtctctactaaaaatacaaaaattagccaggtgtggtggtgcatgcctgtaaccccagctactcaggaggccaaggcaggagaattgcttgaacccaggaggtgaaggttgcagtgagccgagatcatgccactgcactccagcctgggctacagagtgagactccatctcaaaaaaaaaaaaaaaaaaaagagaaaaaaattattcacgaactgtatttttgtgctattttaattgtgattgttttaatcgttattttagcctaaatttttattgcaattagggagaaataactttttttttattgatcctatatcctaaaaccttgctttattggtttactgctctaatatttttctagcggatttgtaaatgtttactattataacattatgacaaaagccaataaagatagcttaacttgtttatttctagtatggagtcttttattctttcattttttaaaccaatttatcttatctagaacctctaatacagtgttgaatggaagtgagaaaagccaatttagtctttctccattaagtgcggtgtcagtgtgtgttttatttatagatactatttgtcagtttaaggatgtttctgaaaggtattgcattaatcacatgattttttctgcctttattaaaatgattatgcagttattgtccttattctaatgatattacatattcaccagttttttgagatgttaaagttagtttgcatttctggcataaaattcccttctggttaaagttagtttgcatttctggcataaaattcccttctgtatgtccaaagctttttgcacatgctagggttctgtttgctagtgtgaaagaaaaataaagaatcaagatcctaaagtcactatgccaaagggaaaaaagtttagcttgggaactgagtcacacaaactgtcagaggcattctaaccagagtgattccaccttgaataagtcagacaaggtcaaacctgccaggttacattcccaggggattgagcactcttggttacaagatactcatggttgagggaatgagttaatgatgataattaactaaataaagacccagaacttatgaaaatgtcccaatagtttgaaaacaaaaacttcttaatttaagaattagttttcctttaaaaaactagcccacttgtaaaatcttgctgaaatcaataatacataggaaaataacaatattaatagcctgtcacaagctgatcacaaacctttgtaataaagtacagtattcttaacaacctatataagcaagcactaagtttaaggtaggggtatttctcttcttgctttctgaggatgccctattctgtaatagagtagtctctaacaaactgttaattttactgtactctgcgactcaccttgcattctttcccacatgagatccacaaacccacccttaacgtctgggacaagaccacttttccagtaatattttcctctggtgactctgctgggacctaaatgaggtgagattccaacccaaaggaaatagactatgcaacaccaattggctgatttgggtaagtggtggaacatatttttatactcgaacagagacactgttcaaaatcggtttagaggcccaacttaggacagttagaggcccttctgacagataagaggtttagaggcctttccgaaagctaagggggttagaagcccttcacaacaagaaatgggttcaatgctacaaaatgttaattactactccctttcaattagccctccctgtgctctctgtcattcactaaagactgtctgctgtctgccaattttctgactgctgactatacttactgtttctttgcagagaccttgcttgatggtcctgagatttttaactttcacgttcctcatttgtctttggattagtggccctttacttgtgtgcttcggcatgttgctaaaagacattagagatgaatggctctgcaagatttactttccctatatctagcccattcgaatgaattatttattgtctcatctctcaaaagattaattgaaatttggtacttacaagttttggtccagtgtgcacgatttagcccagtagcaattatgccaatctcccatgggtgaacagctcccagaaggagaactggagatttctttttggaaattctttttcatcccctcactaatcaactgacctttatttcttgattatgaacagcatgatcatgtaagttttaccctacttaccattactatccttaacctggacattcctctctggatgcatatcatttcccttacttagtgtgacatttctttggtcaggccctctattgtagattctctagttcaggtgactcagctcatttatattatgcgactaacaagaatgccagaattaagtcaactactgaatcattttcccttgcttgtttagctctgaaagctcctttatcctttttagtgaagcttgccctgtggcagcactaccttgttcacaaggatctctaccttcacctgctctgctcctgtgtaatacagctttgatcctgaagagttctgagttctccactaggatgtctagtagagcattggaacaaatttcaattaggtgagcttaagaaaaataaattgacatttttatgtaatactgtttggcctcattatgatttggaatatcaagataaatggccacctaatggaaccacagcctttaatattatacatcaacttgatttgttttgcaagtgggagagaaaatgaggtaaaataccatatgttcaagcatttttattgcttagtcaggatgaaactttacagcaagcgtgtgcatgtttaatgaaaggaaggaaagaaaaggaattagatatactagatgaccctttaatgcaagtcccctgagtccaatgggtgcctttgggtggaacagtacctccctgtgtcagctctaatgcttcaggtgcatctccctctgtctcttctagcccttctagtagtcctgtttagacactttcattcccttctccttacccgtctagtctaattttatacctacctcattctgagaggcccagtcctattctgtaactgtcactccctgaggaggccagccttgctagtactacccagagtggagcctcttctcagtctccaaaggaaaatctttgttggcttagagaagtggcaaatggggaagagcgcactataaggtccctttccccatgttttttttttggtcttatgtaaaggttatttctctgaagacccaggaaaatgtatagataaatttgagaagctaatgctgacttataatttgacctggtaggattttcatattttgttatccacatgttgtacagtggaagaaaaacaatgaattttgggattagctagaatacattcagacaaagtactagcctgcaatcctaatgatatctatagaacaaggggtatttcagtgcctgattaagatctaggattgaactatcaaagaaataggagggcttacagaagagagatcatatgattacttggttattaaaagagaggagagatgtgtgaaaaagtctcttaattattataaggtgaaagaaattactcaaggtaaagatgagaatccagcattatttcagggaaatttggttgaggcaattagaaaatatactaaaattgatcccatttcaatggaaggacaaaccttactggggctgtattttataacccagtctgccactgatgtctgtcagaaactacaaaaagcagcctgggtctgcagacatctatgaatcaacttttcagtatggcatttatggttcttaataacagatacatggcagaggaagtgaaaaacttaagagagcctcctaaaaggcacagtttttagctgcagcattaagcttaccaaccacgtgagatcatccttacacttcttagccatggcaaaggaagctggaaggcagaaagccacaagctggggttctaagcactgcaccttgggtgtaaatcaatgtgctcactgtcataaaattggctattgaaagagggaacacccagcactccaaagtgagtctttggcccctgaacaaatgatggcagttcaagagtgacagggccctagagcttctgtcacagctcccattggacaattagccatatctccagaggagcttcgggtaatcattgatgtgacaggtaacaatattaatttccttttggacatgggtgcttcttactctgttttgactcatcataatgggccattatcatcccaagactctgtggtcatggggataaacggacgagctcatagactccattttccctatcctccaagctgctcttcagggactcttgttttttcgcatgcttttcttataatgcctgaatgtcctactccattttcaggaagagatttatgaactcagctgcaaactctggttttcttcagagatcacaaggcagatgattgattgcttttacttgtctcccatgataagggaagaaaaattaataggagacactctcataatatcttgctatctttacttataccctctttgcagaaagttgaaatttaaaaagggaaaagtaactaggcattcactagaattaggttaactaaaaatttctctgcagagctccttactaggcataggaactacagcaagcatcctgaaggagtctcattagagtgtcttttagacaattgctccaaatatgtccacatagtaaagaaaagatgacacagaacaacatacacaatcaagtatacaaccactacttggtagcattaggggaagttccatggatagatgcttgtaggagctataaaaagaagtggttttggaaggaatcaaaatgagacaaagaccttaaaactaggaaaaaaatgtatctacagagttcagggaatttctgctataaaaattaattgtaacaataaattgtaaaaaaaatgacaagaaaagccaaattgtaatgaaagtgatctgcctaggttacagcagaggcaatcaataaattattctgatgttctcacaatgcagaatatgaagaatgtttgcagaaatcaatacctgttgaagattaactaatgaaaaccaaatgaagaaataaccaactatatacaatatacaatagtatacaactatatacaatatacaatagtttacaatagtatacaactatatactatgtataatagtaacatttgcaccaaaggattatagatatagaaaataaatcaaaatgatgttttataataaacatagttcaaatgtccagagatgaaaaatagttcatataatatatgtatggaaaatgacgagaaccataaacataaaaagaaacacatcaattctagaaattagaaataaactcactggttacactaaaatgtaattgataacatgaaataaaatggaactgaatgaatgaacaaaagaacaaacaataacagcagtagaaagaactagtgaatctttctatttttctccctgaatcttgactcatagagccccaataggaatcacctaatactctaggaattgccactaagctgattaaaatataaaagtgttatttgttaaaaaagaaaaaaaagctgaattagtgctctcccgattgcctgctttattcccaaaactctcttatttctaattgttttactggtcttaatcattcatgctatgtttcactgaagtatttgtgaaatatttcatgtgtttatctcaattttgattttatctcaattttggtttcattctatcttgactcttgcaacctgcatgtcctcattttactttaccaatccagctccaaagacaaccttctcatagacctaggatttctcattaaatttttaccagtttatctgagcttcattgatcttgtttctctgccaattactctgagccactgtcatcatgacctaaaattttttcacaaattacaaatttaccctttataatttatctgtgtcaaggaagactctgtagacaataccagaagaaaaaaatgtgtgcagtacatgaatgaaaaacctgatgtttcctgactttttgatgattgtcattctaactggtgtgagatgatatctcattgtggttttgatttgaatttctctgatggccagtgatggtgagcattttttcatgtgttttttggctgcataaatgtcttcttttgagaagtgtctgttcatgccctttgcccactttttgatggggttgtttgtttttttcttgtaaatttgtttgagttcattgtagattctggatatgagccctttgtcagatgagtaggttgtgaaaattttctcccattttgtgggtggccagttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaataggatgtggagaaataggaacacttttacactgttggtgggactgtaaactagttcaaccattgtggaagtcagtgtggcgattcctcagggatctagaactagaaataccatttgacccagccatcccattactggatatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccacatattctcactcataggtgggaattgaacgatgagatcacatggacacaggaaggggaacatcacactctggggactgttgtggggtggagggaggggggagggatagcattgggagatatacctaatgctagatgacgagttagttagtgggtgcagcgcaccagcatggcacatgtatacatatgtaaccaacctgcatattgtgcacatgtaccctaaaacttaaagtataataattaataaataaaaaaatgaaaggacaagagtaggaaagtgtaaaaaaaaaaaaagaaaaacctgactgaatcataaacaaaaataggcaattagattaaaaatttagtatttgctaattaaatcaatgatagatttttatatactttggattggtaaaaattaatatcaccataggggaagaaccaactacctggccactccagtgctgtatagagtggcaatagtagaaagatacacacgggctcaacaaactctctctacttaaaactaaggtagctattactgaaatcaaaaattcaacctgctaatatgtaaattctgatcatacctttagagatcagagaagtgaccagtagtgaggctgcagacacaatgaaacaactctaatctcaccttgttatgaactgtatctgctcctgtgttgaagagcttcatttgcgtaagattttgctttttcttcatctgaattttactatgaggcaatgcacaagattttaacaacctatagatactaactgatatgatttggctgtgttcccacccaaatctcatcttgatttgtagcttttataattccatgtgttgtgggagggacctggtaggagataactgaatcataggagcagtttcctccatacttttctcatagtagtgaataagtcttatgagatctgatggttgtataaagggcaacacctcttgcttgggtcgcaatactcacttgcctgctgccatatcagtttcctccatacttttctcatagttgtgaatgagtcttttgagatctgatggttgtataaagggcaacatctcttgcttgggccgcaatactcacttgcctgctgccatatcaatttcctccatacttttctcatagttgtgaatgagtcttttgagatctgatggttgtataaagggcaacatctcttgcttgggtctcaatactcacttgcctgccatcatatcagatgtgactttgctcctccttcctttccaccatgattgtgaggtctccccagccatgtggaactgtgagtcattaaacttcgttcctttttgaattactcagtcttgagcatatctttattagcagcatgagaaagaccaatacagtaaattggtactaggccatagggcactgctataaagataccagaaaatgtggaagcaactttggaactgggtaacaggcagaggttggaacagtttggtgggctgagatgacaggaagatgtggaaaagtttggaacttccttaagacttgttgaacggctttgaccaaagtgtgataatgatatgaatgataaaatccaggttgaggtggactcagatggagttgaggaatgtgttgggaaatggagtaaaggtcaattgcgctatgcaaagagactggtggcatctagcccctggcctagagatatgtggaactttgaacttgagagagatgatatgaggtatctggtggaagaaacttctaagcagcaaaatattcaagaggtgacagagtataaaagttgggaaaatttgcagtctgaaaatgcagtagaaaagaaaaccccattttctggggagaaattcaagttggctgcagaaatttacataagtaatgaggagccaaatgctaatcatcaagaaaatggggaaagtgtttctggggcttatcagagaacttcacggtagaccctcccatcacagattgtagggaaaagaaagagagatcagactgttattgtgtctatgtagaaagggaagacataagaaattccattttgacctgtaccttgaacaattactttgctgagatgccggtaatttgtaactttgccccagccactttgcctcagccactttacctcagccactttgccccaactttgagctcacaaaagcatgtgttgtatggaatcaaggtttaatggatctagggctgtgcaggacgtgccttattaacaaaatgtttacaagcagtatgcttggtaaaagtcatcgccattctctagtctcaataaaccaggggcacaatgcactgtggaaagctgcagggtactctgcccttgaaagccaggtattgtccaaggtttctccccatgtgatagtctgaaatataacctcctgggatgagaaagacctgactgtcccccagcccgacacccgtgaagggtctgtgctgaggtgggttagtaaaagaggaaagcctctcgcagttgagatagaggaaggccactgtctcctgcctgcccctgggaactgaatatgtcggtataaaacccaattgtacagttgttcaattctgacataggagaaaaactgccctatggcagtaggtgagacattttggcagcaatgctgccttgttattctttactccactgagatgtttgggcagagagaaacataaatctggctacgtgcacatccaggcatagtacctccccttgaacttaattatgacatagattcttttgctcacatgctttttgctgacattctccttattatcaccctgctgtccgacacattcctcttgctgagataatgaaaataataatcaacaaaaactgagggaactcagagactggtgccagtgcaagtccttggtatgctgagtgctggtcccctgggcccacttttctttctctatactttgtgtactgtacagtctccaacgggcattatttttcaaaatacagaccttgtgcggtggtcattccttcctcacagtataattaagacttttacattgtatttagatgaaatggctgcattaattggtcaggcaagactatgaatagtaaaatcgtgtggaagtgacccagatgaaatcattgttcctttaaacaaggaacaggttagacaagccgttgtcaattctggtgcatgacagattggtcttaccgattttgtgggaattattgataatcactacccaaaaacaaaaatcttccatttttaaaaattgactacttggattttacctaaaattaccagacataaacttttagaaaatgctctgacggtgtttactgatggttccagcaatggaaaagtggcttacacaggccaaaagaatgagtcattgaaactcaatgtcactcagctcaaagagcagagttggttgctgttatttcagtgttacaagattttaatcagcctattaacattgtttcagattctgcatatgtagtacaagctaaaaaggatgttgagacagccctaatcaaatatagcatggatgatcacttaaaccagctgtttaatttattacaacaaactgtaagaaaaagaaatttcccattttatattactcatattagagcacatactaatttaccagggcctttaaagcaaatgaacaagctgactcgctagtatcatctgcattcataaaagcacaagaacttcatgctttgactcatgtaaatgcatcaggactaaaaaataaatttgatatcacatggaaacaggcaaaaaatattgtacaacattgcattcagtgtcaagtcctacacctgcccactcaggaggaaggacttaatcccagaagtctaagtcctaatgctttatggcaaatggatgtcacatatgtacctcatttggaaaattgtcatttgtccatgtgacagttgatacttattcacatgttgtatgggaaacctgccagaaaggagaaagtacttcccatgttaaaagacatttattatcttgttttgctctcatgggagtatcagaaaaaattaaaacggataatgggccaagatactgtagtaaagcatttcaaaacttcttaaatcagtggaaaattacacataaaacaggaatcccttatgattcccaagggcaggccataattgaaagaactaatagaacactcaaagctcaattggttaaataaaaaaaaggaaaaagagagtagaagtgtaacacttcccagatgcaacttaatctatctagcacactatactttaaattttttaaacatttatagaaatcagaccactacttctgcagaacaacattttactggtaaaaagaacagaccacatgagggaaaactgaattggtggaaagacatgaaaaataagacatgggaaataggtaagatgataacatgagggagaggttttgcttgtgtttcaccaggagaaaatcagcttcctgtttggatacccacaaggcatttaaaattctacaatgaacccatcggagatgcaaaaaaagtgcctccacagagacagaaaacctgcaatcgagcatcatctactcgccaggtgaataaaatggtgatatcagaagaacagaggaagttgccatccaccaagaaagcggagccaccgacctgggcccaactaaaaaagctgacacagttagctgaaaaaagcctgaagaacacaagggtaacacaaactccagagaatatgctgcttgcagctttaatgattgtatcaacggtggtaagtctccctatgtctgcaggagcagctgcagctaattacacttactgggcctatgtgcctttcccgcccttaattcgggcagtcgtttggatagataatcctattgaagtatatgctaataatagtgcatgagtgccaggccccacagatgaccgtggccctgcccaacctgaggaagaaggaatgatgataaacatttccattgggtatcattttcctatttgcctggggaaggcaccaggattcttaatgcctacaacccaaaattgattggtagaagtacctactgtcagtgccaccagtaaatttacttatcacatggtaagtggaatgtcacttgggtcacaaataaataatttatagcactcttcttattaaagatcattaaaatttaggcctcagggaaaaccttgccccaaggaaattcgcaaagaatcaaaagacccagaagtcttagttcaggaagaatgtgtggctgatactgcgatggtattacaaaacaataaatttggaactattatagactgggccccttgaggccaattatattatgattgtacaggccagactcactcatgttcacaggccccatctgtctggcccactaatctggcctatgatagtgatttaactgaaaggctagaccaggtttatagaaggttagaatcaccctatccatggaaatggggtgaaaagggaatttcatcacctcgaccacagttagttactcctgttactggtcccgaacatccagaattatggaagcttactgtggcctcacaccacattagaatttgatctggaaatcaagttatgggaacaagaaatcataagccatattatactattaacttaaattcctttgcaaagttgtggaaaacccccttatatgctagttgtaggtaacatagttattaaaccagattcctaaactataacctgtgaaaattacagattgtttacttgcattgattcaacttttgattggcagcaccgtattctgctagtgagggcaagagagggcgtgtggattcctgtgtccatggactgaacgtgggaggcttccccatctgtccatatgttaacagaagtattaaaaggagttctaactagatccaaacgattcatttttactttgattgcaatgattatgggccttattgcagtcgcagctactgctgtggctgctgtaattgctttacactcctgtcttcaaactgcagaatatgtcaataattggcaaaagaattcttcaaaattgtggaattctcagacccaaatagataaaaaaattggcaaaccaagttaatgatcttagacaaactgtcatttggatgggagattgacttgtgactggaatatgtcagatttttgtattaaacctcgagcctgtaatgaatctgaatatcactgggacacggttagacaccatctacaaggaagagaagataatattaccttagatatttcaaaattaaaagaacaaatttttgaggcatcaaaatcccagttaaatctggtgccagaaactgaggaaatggtgaaagctgctgatagcctcacaaatcttaaccccgtcacttgggttaaaaccattggaagttccactattgcaaattttgtattaatccttgtgggtctgttctctctgttgttagtctacaggtgtatccagcagttccagagagacagcgaccagtgagaatgggccatgatgacgatggtggttttgtcaaaaagaaaaaggggatatgtagggaaaagaaagagagatcagactgttactgtgtctatgtagaaagggaaggcataagaaattccattttgacctgtaccttgaacaattgctttgctgagatgctggtaatttgtaactttgcccagccactttgccccaacttcgagctcacaaaaacatgtgttgtgtggaatcaaggtttaagggatctagggctgtgcaggatgtgccttgttaacaaaatgtttacaagcagtatgcttggtaaaagtcatcgccattctctagtcttgataagccaggggcacaatgcactgcagaaagcgcagggacttctgccgtggaaagccatgtattttccaaggtttctccccatgtgatagtctgaaatatggcctcatgggatgagagacctgactgtcccccagcccgacacccatgaagggtctgtgctgaggtggattagtaaaagaggaacgcctcttgcaattgagatagaggaaggccactgtctcctgcctgcccctgggaactgaatgtcttggtataaaacccgattgtacatttgttcagttctgagataggagaaaaaccaccctttggtgggaggtgagacatgttggcagcaatgctgccttgttattctttactccactgagatgtttgggtggagagaaatgtaaatctggcctacgtgcacatccaggcatagtacctccccttgaacttaattgtgacatagattcttttgctcacatgtttttctgttgatcttctccttattatcaccctgctctcctactgtattcctcttgctgagataatgaaaataataatcaataaaaactgagggaactcagagactggtgccagtgcaggtccttggtatgctgagcgccagtccactgggcccacttttctttctctatactttgtctttgtgtctgatttcttttctcagtctctcatcccacctgatgagatataaccacaggtgttgaggtgctggccaccccttcacacctatggatatatcttgacaggtgggtcacacaaattgggaaaatttgcagtagaaaagaaaaccccattttctgggcagaaattcaagttgtctgcagaaatttatgtaagtaatgagaagccaaattctaatcatcaagaaaattgggaaaatgtttctggggcatatcagagaacttcacggcagaccctcccatcacaggcctggagtcctaggaaggaaaatggtttcacaggccaggcctagggccccccatgctctgggcagcttcaggacatgatgtccttcatccaagctgtttcagctccagccatggctaaaaggggccaaggtatagctcaggccattgcttcagagggtgcaagccccaagccttggtagcttttctggggtgttgagcttgcaggtgtacagaagtcaagaactgagttttgggaacctgtgcttagatttcagaggatgtatggaaatacctagatgtccaggcagaagtttcctgcatgggcgggaccctcatgcagaaactctgctagggtagtcagaagggaaatgtggggttgaagtcccaacccagtgtcgccactggggcaccacctagtagagctgtgagaagagggccaccatcctccagaccccagaatggtagattcactgatagctttcactatgtgcctagaaaagctgaagacactcaatgccagcctgtaaagtagcagggagggaggccctaccctgcaaagtcacaagtgtgaagctgcccaagaccatgggaacccactacttgcattagcgtgacctggatgtaagacattaagtcaaaggagataattttggagttttaatatttgactgcccctctggattttagattcacatgaggcatgtagcccctttgtttttgtcaagttctcccatgtggaatggctgaatttacccaatgcctgtactcccatgtattgaggaagaaactaacttgtttttgattttacaggctcataggtggaaggaacttgccttgtgtcagctgagactttggactgtggacttttgaattaatgctgaaatgaattaaggctttgggggactgttggaaaggtatgctttgttttgaaatgtgagggcatgagatttggagaggctgagggcggaatgatatggtttgtctccacccaaatctcaccttgaattgtagctcccataatttcatgtgttgtgggagggacctggtgggagataattgaatcatgggggcaattttttccatactattcttgtggtagtgaatgagtctcaatagatctgatttttttttttttttttttttttgagacggagtctcactctgtctcccaagctggagggcaatggcacgatctcggtttgctgcaacttccacctcctgggttcaagccattctcctgccccagcttcctgaacagctgggactacaggcacatgctggtacatccagctaattttttgtattttttttttagtagagatggggttttaccatattgcctgggctggtctcaaactcctgaactcaggcaatccgcacacctttgtctcccaaagtactaggattacaggtgtgagccaccacacctggcctgatctgatgattttataaaggaaacccctttcatttgggtctcaatgttctcttgcctgccaccttgtgatatgtgaatttgctccttcttgccttctgccatgattgtgaggcttccccagccatgtggaactgtgagtctgttaaacctctttcctttataaattactctgtattggatatgtctttattggcagcacgagaacagactaacacagtaacaaatgagaaatttataatattgttgtctgctataccacttttcaatttgttgaaggtggagatttttaagcagtaggaaatccttagatggttattacaaaataggatgattataatgaaaattaatgtgcttaaaataaaggttttaatacaatatcatcagaagttgggagaattaatggaacccctagaaagttcccgaaccctcagacttccaagccaatctgctccatttatcacagtttggagtagtttacaaagcacaaatgcagaaatcacaatgtgaaaatttattaacgctttcctcagataatattgagatattaatcaagataaaagtttgcaaaaaggcaagcgtctcttggctcaatcaccttgtacagacacaaaacacattaagtcctaatagagcctaagtaaaggttaatgaaatgaagataaaaggttatagaaaagttggtatatatccacaagctttatgtgaagtagttacatctcttttatctgacagtattattagaatggacattgtatctaactgggaaatgtttcccacatctagtattatacaatggaaggcatccaaatttgtctttaaatcattatgaattgggcattctaaatagaagccagtaagatattccatccaagttcatacagtgtagaatagaagctggagtgctgatagaaaaaaattctctgttcgatagccctatatcaagcataacttatagtaatatgctgtgagtatctcccagtgataaatactgggatttgggaaaggagaatttccacttgagtggcatttactaccttgctgtagtacattaattgaagctatccataacagttcatcaaataaccttgaaacatgaaatacccatgatgtcttgcataatgtaaatgaaacactccagtcatatagcagtacccagaagagttttgtactacaatggaaattgtctatatagaatcaaactgcgtcatgaatgcctgaaggagatattcttaagctcagaacccctttcctcctaggactgattctgaaactgtgtgaggagttgcctaattccacagtgctctataaatagctcacaactgactgacaaagatctgctaggcttgtagatggcacttacagggtgaatgaacaaactactgccatattgattctttttttctagttcttatgtaaatcctttttaaaaaaagggtttttttttttttttttttttttttttggaatggtctcactctgttggccaggctgaagagcatacaattacagtttactgcagcctcagcctcaaactcccaggctcagatgattcaccaacttcagtcccccaagtagctgggactacaggcatacatggccatgcctgacatttttaaaaagctttatttgtaggtatagggtctcactataatgccctggctggtgttgaactcctaggcttaagtccttctctcaccttagcctcctagaatgccaagattataggtgtgagctgctgctgtatctggtctgtaaatccttttttctgtcttcatcatttattggcttccttggaattaagggattatcttgttgtatgtttttatttcttcctttttatttttagggtatttattataggtgttctgtgcttatcataaggcttacatgaaaacaccttcttttttattatactttaagttctagggtacatgtgcacaacatacaggtttgatacataggtgtacatgggccatgttggcttgctgcccccatcaactcatcacttacattaggaatttctcctaatgttatatccctcctccagccacccacccccaacaggccccagtgtgtggtcctctgccctgtgtccaagtgatctcattgttcaattcccacctatgagtgagaacatgcattgtttggttttctgtccttgtgacagtttgctgagaatgatggtttccagcttcatccatgtccctgcaaaggatatgaactcatcattttttatggctgcataatattccatgctgtatatgtgccacattttcttaatccagtctatcattgatggacatttgggttggttccaagtctttgctattgtgaatagtgctgcagtaaacatacgtgtgcatgtgtctttatagtagcatgatttaaaatcctttggatatgtacccagtaaagggatcgctgggtcaaatggtatttctagttctagatccttgaggaatcgccacacagtgctccacaaaggttgaactaatttacactcccaccaacagtgtaaaagcgttcctatttttccacaccctctccagcatctgttgtttcttgtctttttaatgattgccgttctaactggtgtgagatggtatcttattgtggttttggtttgcatttctctgatgaccagtgatgatgatcattttttcgtgtatctgttggctgcatagatgtcttcttttgagaattgtctgttcgtatccttcacccactttttgatggggttgcttgtttttttcttgtaaatttgtttgagttctttgtagattctggatattagccctatgtcagatgcgtagattgcaaaatttttctcccattctgtaggttgcctattcactctgatggtagtttcttttgtcatgcgcaaaagctttttgtttaatttgatcccatttgtcaattttggcttttgttgccattgctttttgtgttttagtcatgaagtccttgctcatgcctacatcctgaatggtattgcctaggttttcttaaagggtttttatggttttaggtctaacatttaagtctttaatccatcttgaattaatttatgtgaaaagtgtaaggaagggatccagtttcagctttctacatatgtctagccaattttcgcaccaccatttattaaatagggaatcctttccccattgcttgtttttgtcaggtttgtcaaaaatcagatggttgtagatgtgtcgtgttatttctgatgtctctgttgtgttccattggtctacatctctgctttggtatcagtactatgctattttggttactgtagccttatagtatagtttgaagtcaggtagcaagatgcctccagctttgttatttttgcttaggattgtcttggctgtgtgggctcttttttggttctatatgaattttaaaatagtttttttccaattctgtgaagaaagtcattggtagcttgatgggaataccatcaaatctataaattaccttgggcagcatggccattttcatgatatttattctttctatccatgagcatggaatgttcttccatttgtttgtatcctcttttatttcattgagcagtggtttgtagttctccttgaagaggtccttcacatcccttgtaagttggattcctaggtattttattctcttagcagcaattgtgaatgggagttcactcatgatttggctctctgttggtctgttattgatgtttaaaaatgcttgtgatttttgcacgtccattttgtatcctgaaactttgctgaagttgcttatcagcttaaggagattttgggctgaaaagatgggtttttctaaatataaaatcatgccatctgcaaacagagacaatttgacttcctcttttcctaattgaatactctttatttctttctcttgcctgatcaccctggccagaacttccaacactatgctgaataggagtggtgagagagggcattcctatcttgtgctggttttcagagggaattcttccagtttttgcccattcagtatgatattggctgtgggtttgtcataaatagctcttagtattttgagatacgttccatcaatacctcgtttattgagagttttagcatgaagagttgttgaatttcattgaaggtcttttctgcatttattgagataatcaagtggtttttcattggttctgtttatgttatggattatatttatttatttgcatatgttggaccagccttgcctcccagctgacttaatcatggtggataagctttttgatgtgctgctggattcggtttgccagtattttattgaggatgttcgcattgatgttcttcagggatattggtctaaaactctgtttttttgttgtgactctgccaggctttggtatcaggatgatgttggcctcataaaattagttagggaggattccctccttttctattgattggaatagttttagaaggaatggtaccagctcctctttgtatctctggtgaaattcagctgtgaatccatctggtcctggactttttttcattggtagcctattaattattgcctcaatttcagagtctgtttctggtctatgcagagattcaacttcttcctggtttagtcttgggagggtgtatgtgtccaggaatttatccatttcttctagattttctagtttatttgcgtagaggtatttatagtattctctgttggtagtttgtatatctgtgggatcagtggaggtatcccctttatcattttctattgagtctatttgattcttctctcttttcttttttattattcttgctagtggtctatcaattttgtcgatcatttcaagaagccagctcctggattcattgattttttggaggtttttttttgtctctatctctttcagttctgccctgatcatagttatttcttgccttctgctagcttttgaatttgtttgctcttgcttctctagttcttttaattgtgatgttagggtgtcaattttagatatttcctgctttcttttgtgggcatttagtgccataaatttccctctacacactgctttaaatgtgtcctagagattctggtacattatgtctttgttctcattggcttcaaagacatatttatttctgccttcgtttccttatttgcccagtagtcatgcaggagcaggttgttcagtttccatgtagttgtgcagttttgagtgagtttcttaattctgagttctaatttgattgcactgtggtctgagagacagtttgttgtgatttctgttcttttacatttgctgaggagtgctttacttccaattatgtggtcaattttagaataagtgggatgtggtgctgagaagaatgtatattctgttgatttggggttgaaagttttgtaaatgtctattaggtcttaaacttaaagtataatttaaaaaaagaaagtaaaaagatgataatccacttcatgaaaacacacaaaattatataactcactcatagagccaacagacaaaggagaaagaaaaaagaatcaaactttatcagtatagaaaactaccaaactgtcaaaaataagtaataagagagaaattaaggaataagggttatacaaaataaacagaaaaaataaaagaataagcctttacctataaatacataaataaataccttgaaaataggtggattaaattatacaactcaaaacatagactaatggattaaaaaacaagacccaactatatacagcctaaaagaaactcatctcacctataaagttacacatagactgcaattgaaaagatgaaatagatatgctatgcaaacagaaacccaaatcaagcagaaatagcttcacttacataagcaaaacacaaactttaagccaaaactttaaggagaggaaaagagagacttaatatgataataaatgaatcaattgttcaaaaagacaaaaatgtaaatatatatgcaaacaaccatgaaccattgagatatatgaagcaaatattattatacctgaaaggagagatggacctaagttcaataatatttgaggatgtcaccaccaccttttcagcattggacagatatttagacaaaaaatcaatagaaacacatgagatttatactgtaccatagaccaaatcgaagtaattgacatttacagaacattttatccaacagctgcagaatataagattctttttatagcacatataacatccccagaattaaccatatatgaggacattaagcaagtctcaacaaattttaaaaaataaaaattttactaattattttatctgaacacaatgaaataaagtataaaatcaatgacaagacaaaactagaaaaatccatgaaaatttaacaacgtattccttataaccaataggtaaaaaaagaaacaattttaaaattacttaaaacaagaaaaattacatcatgcgatagcaaaatgtatgagattcaacagaagcactattaagagacaagtttagaacaagaaatgcctacatgaaagaagtagaaaagtttcaaataaacaacctaatgatctctctcaaagaactctaaaaataggaacaaaccaaaaccaaaattagtgtaagtaaagaaatactaaaaattagagagaaaaaatgaaattaagactaaaaaagatgaaacaaaatgctaacttttttaaaagacaaaatcagcaaggcattgactagactaataaagaaaaacaagaaaatatccaatttaataaaatcaaaaacagaacaggaaacttcacaactgatacagaaatacagcacatcattaaagattgtaatcagcaactacacaacaaatttgaaaacctggaagaaatggatacatttcttgacatatacattagactaagataaaaacaacaaaaaatataaatcttgcacagactaatactgaataacaacattaaatcagtaacaaaaagccctccaataaataaaagtccaggactacctggagtcacaactgtattctaccaactttaaattattatgctaactacagaaaccagttacaaaaaacacatcttgtgtgattccatttatatgaagccctcaaaattggaaaatgtatagagacagaaagtagattagaggttgtccagggttgagggataaggagatgctaaggatacgaggttagttaaggatgatgaaataatgtaaaattgaacatcacgatagtcacacaaattctgtgaaaatacaatgagccactgaattgtcttggctttaaattagtaaactgtattatatgtcaaatatatgtcaacaaaacttttacaaaacaaataaacaaacatcccttggaccatgatatctaagaaagtctgattcagctgtgtaagtactttaggcctacgccaagcagactgcagacacaaagcacctcttgctatccactgttcataacatgattctaaactttcttatatcacataggtgatttgtatttgcaagataatcagaacttaaatggggaaaagcatttgtaattgttaaaagagatattaaacacatcatataacacaaggtcatctagatttcactttttccacttgccatgaagatactctgaccattcaaataatgtacttacattgatatgtagtagttatattttaaattcttgacaatctcttctttaatataagcaagataaatggtacagggataaaatttgaaaggaagtaccgcatttaatcaggatgtctatgaaatgaatttcagctctactatagctactgctgagttttttcctcaactctggaagtcgtgaaaaggtgctgatgtagctatggaatacagtcattggatcgatttagaggcaaaactggatgaacttatccagatgaatcatgagatcattgtgagaccatcggcttccatttttcttgatctcagcaaaccatttgctattaccttggaatttaattctatatctttattgaaagaaaacttaaaggattattgtctcagttaataaatataattggtggaaagatatattttagacatttatttcattcatcaaaaaatattttgcaaatattttgtttattttaaaagctctgtcagatgttgttttacaaatagaaaagtatcgcaggcttatggattggaaaaataaatattgtgaaaatgaccatactgcccaaagcaatctacagattcaatgcaatttctattgaattatcaatgtcatttataagataattataaaatataattctaaagtttatatggaaccaaaaaaagaacccagattacaaaggaaatcctgagcaaaaggaacaaagctgatggcataacattacctatcttcaacatatactacaaaactgtagtaaccaaaacagcaaagtactggtataaaagtagacacatagaccaacagaacagaatagagaacccagaaataaagccaaatacttaaaaccaactgttcaacaaagcagacacaaacatgcacaaaggaaaggacactctattcaaaaaattgtgatagaaaaaaaggagagccacatgcagaagcgtgaaactggatgactatctctcatcatatgcaaaaattaactgaaggtggattaaagacttaaatgcagaagaaaatataagaaatactcttttggacattgacctacacaaagaatttatgactaaagacacaaaaagaaaagcaacaaaaccaaaataaagaaatgggactttaaaaagcttctgcacagcaaaagaaataatcaatagagtaaacagacaacgtacagaatgggagaaaatatttacaaactctatatctgacagaggattactaatcagaatcaacaagtaactcaaacaaatcagcaagaagaaacaatcttataaaaaatgggcaaatgacatgaatagacatttctcaaaagaagatatacaaatggtcagcaaatatggaaaaaagctgaacatcagtaaccatcagggaaatgcaaattaaaaccacaatgagatatcacctgactaatggtatactcttatcagaatgattgtattttaaaagtcaaaaaaagtagatattggcgcagatgtggtgaaatgggaacatttaaacactgttggtgggaacataaactagtacaacctctgtgaaaaactgcatggagatttctcaaataactaaaagtaggtaaaatatttgatccagtaatcttactaccagttacctacacaaaggaaaggaagtcattatattaaaaagacatctgcactcatatgtttattgcaacaaacttcacaattccaaagatatggaatcaacctaagtgcccatcgacagatgagtgaataaagaaaatgtgatctatatatcacatggatatacacggccacatctcacaggaaaaattccagatcatccatgggaacttccccttacctcagcgcctttggggactttgaccaaaactaggaaggctgcatcagtagggaaaagatgctttccttttcctgtgcttcagctccttgctgggagtctacatgggttttgtacacagtttccaggagggcaactcctagagtgcagtagcctgctgccactgcgaagccctgatcctgggcatctataagcagggcctcaactgccaagccagtggtatgagctgccaccagcagtgcaaggattgcctgtaagttgagcaccagtgcaggccccagagtgtgggcctggaggagtctccacgtcaccctcacacactcatacccaccatcatcccaccttcagcttctccctgccctgccatggcaaacgagactcccagcctccagagattcatgaggaggagatgcagatggtgaaggatggggtgtttgacaactgcttgtaattgatgctatgattggatcaaggactcattcctgccttggagaaaagacttgaaccagagcagggagcctgggggtgctgggacagaaggttggggctgagggcagaatgtgatggtggcatgcagctaagggcagggccagggcaggcgtccctaaggttgtaccaacttttgtgaatatttgtattttcctcatggaataaaaaggctcatgtaattaatctccatatatatatacatttatatatgtgtatatatacatttatatatatataaatgtatacacacacacacacacacacacagaaagagagtagtatatacatacacagcatacatgcatatatattcccttttttctgggagtttttccactcatttccattcaccaaagcaatgcctttgtgccatgtacgtgaagaaatattcgtctgctctagcaaagacctcatctggcacagaagctgtcagggaaacaactacttggttgaatttgcaggagggaaaaggggagacttctttgagatccctggtttttttaatgaagactttatatggcttaccctgtgagaaatgttaaatttctggacaatccttggctaaccagatctgtatattagtacgttccaagttgttcagcagaacagcagacaaattacttttatttttaatttcaatactctttgctttagaaacaattttgctgtggcacttcctagtctgtgactctgtcttgaaaagggctggaactcaggctgcgtagacatacatatttcatttatctggtcttcaacttaaacattcacctctttataaaaacttctctgtaattctgaaggtaattcccctttttttgatggagttcaaaaattgctgacttgcactgttgggaaatcatcactgactgtgatttcattttccatactttcatatttacatccacctgctttttctgttcagtgggagacaagcagttggagccaaccttctgagcttcttcaaaaaggctatcaacaaaatattcacaatttgttgattatcactgagagattgattgtcagatactgtttcacaaacccatcttcttttatactttcgagattatctacctctttcattctcttttgtcttattctgggcagggtctcctggcctcagcctcactcagctcagaggccacgagcaccctttggccccgggctccgtctggagcccgctgctccagacctccttaggttccgccgcggcacagctaggatcctgacggactctctaggtctctgccaggcaccagacaccaaaagcatgctgatgtagtctcaattgatttgtttttaaattggtaattaaacctccacctttattgaaagatcatttggaagattttgttctcatactcggtcagttaataaacatatgatttgtcaaaagatagattttagaaacattttatgaattcaaaaaatttgagggaaatatttgggttgttttagaagctctgtcaagatgtagttttaatcaagaaacttatgtcaaaagtttaagaatcaagccttaatattattcttgcagatgtccttggtaaaatctgctggtggggataattaaaatacacattgtatatactttgtatttcctttttggccttttttttttttttaatggagtctaactgtcacccaggctggagtgctagagtgcagtggcacaatcttggctcaccacaacctctgccttccagatggaagcaattctcgtgcctcagcctcctgagtagctgggactacaggtgtgccccaccacgcctggctaatttttttgtatttttattaaagatggggtttcaccatgttggccaggctggtcttgaactcctgacctcaggtgatctctctaccttggcctcccaaagtgctgggattacaggtatgagcccctgtgcccagcccagtgtggagcttctattcactcctttctatgtacctgtggttctgtcagaattaagtgatcaaataacataaatggagatggtaaaaaaatgtgataagacatcagaaagatagtgggatagaaagccagcaactcatgtctccccttgcaacaataagaatttttcacacaaccacagataaaagactctttagttttggtattcaggtaggatgttgtgaaacccctgtgtagcccaagacctagcaagggcattttgagaatacataacagaactcaggtattagactcacttataatgccagaaacagccccatttcccaaaaagcttgtctacagccctgtttggccttgagcctgtaatcaaaattatcttcccaggagtccaggaggaatcatactcactagtgccttagcagaaaagcttatctgtccaccaacattggtctcagcagcagaattgacagttatcctgtaactcaggggaaaccccttcagttgtggtgccagattattactgcttgggcaaggacatagaagcagatttacccatgtctttcagtccagtaattacctgttcatctgagtgtgtgacaggcctgtcaatcttcattcaaacacaaattatgaggaagcctagtttcagctctagcccttctggctgcagttggagaactatcctacccacataggaaagtgctgggggttgcttgtccacctgctaatgaggtcggctcaccatcctccttctgcagtaagtccctagggagcccagccccagctccaaccttcctttctgcagtcagggaccttccctgctcgtgcagaaaactattgggaagcacatttgcctgggccaccatccaggctcaccagtctctgctcccagagcatattctgggagtgggaagggcagtctcgactcaaacccctcttgctacattcaaagaactgcttctacttttcaagaaagacaaaagagacaagagacaaaagagcagaaggctattcaaagaaataatagcggaaaactttcataacttggagaagatataaacatccaggtagagttaggtaaaattaaccgataagatacaacataaataagattactctaatatatattataatcaaactctcaaaagtcaaagacaagctgctgaaagcagcaagataaaagaagtaaaatgcatgtaaaggaattacaagacatctggcaacagacttctctggagaaaccttgtcagccatgatagtgtcagacaatacattcagagtacctaaggcaaaacaaaacaaaacaaaacaaaacaaaacaaaacaaaacctgccaatcaaaaatactgcatccagtattagaaatgctatcctttagaaatgaagtagagataaagactttccagacagactgagtaaatctagcatcaccagacatgtcctacaagaaatacaaaaatgagttattcaaactgaaggaaaaagatgtttttgcataacaagaaatcatctgaagacagaaacttcactggaaaatgtaagtaggaaggcaaattcagaatactctaatactgtaattgtagtgtgtaaaccacttacatcttcagtataaatactaaaagacaaaacaataaaaagtaataataactacaaaaatttattaagagattggaaatataaaaaatgtaaattgtggcatcgaaaacttaaaatacaagggaatattacagttaaagtatacaggggttttttttgcttctctttcaaatcaaagataattgtattggtttaaaataactttttataagatatttttctctccattccaagatggctgaacaggaacagccccggtctgcaactcacagcatgatggatgcagaagataggtgatttctgcatttccaatggaggtacctcgttaatctctttgggactggatggacagtgggtgcagcccacggagggtgagctgaagtgtaaggggtcagggtgtttccctttcctagcaagggaagctgtgacagactgtacctggaaaaatggggcactcctgcccaaatattgcacttttcccagggtcttagcaactggcagacaaggagattctctcccgtgcctgacttgggggggtcccatgcccatggagccttgctctctgctagcacagcagtctgagatcaaattgtgaggcaacagcctggctgcaggaggggtatccatcattgctgaggcttgagtaggtaaacaaagcagccgagaagcttgaactgggtggagtgcatggaagttcagcaagccctactgcctctagactccacctctgtggacaggacatagctgaacaaaaggcagcagacaacttctgcagacttaaacgtccctgtctgagagctctggagagagcagtagttctcccagcacggagtttgagctctgagaacagacagactgccttctcaagtgggtccctgatccctgtgtagcctaactgagagacatctcccagtaggggccaacagacacctcatgtaggtgggtgtgcctctggtacgaagcttctagacgaaggatcgggcagcaatatttgccgttctgcaatatttgctgttctgcagcctccactggtgatacccaggcaaacggggtctggagtggacctccagcaaactccaacaaacctgcagctgagggacctgtctgttagaaggaaagccaacaaacagaaaggaatagcatcaacatcaacaaagaggacctccacaccaaaaccccatctgtaggtcaccaacatcaaagaccaaaggtagataaaaccacaaagatggggaaaaaccagagcagaaaagctgaaaattctaaaaatcagaatgctacttctcctcaaaagtatcacagctcctcaccagcaacagaacaaagctggacagagaatgactttgacgagttgatagaagtaggcttcagaaggtcgttaataacaaacttctctaagctaaaggagcatgttcaaacccattgcaaggaagctaaaaaccttgaaaaaaaggttagacaaatggatagttagaataaacagtgtagagaagaccttaaatgacctgatggagctgaaaaccatggcacgagaacttcgtgatgcatgcacaaggttcaatagctgaatcaatcaagtggaagaaagggtatcaatgactgaagatcaaatttatgaaataattgtgagaagacaaggtaagagaaaaaagaagaaaaagaaatgaacaaagcctgcaagaaatacaggattgtgtgaagaggccaaatatacattagattggtgtacctgaaagtgatagggagaatggaaccaagttggaaaacactcttcagtttattatccaggagaacttccccaacctagcaaggcaggccaacattcaaattcaagaagtacagagaacaccataaagataatcctcgagaagagcaaacccaaggcacataattgtcaggttcaccaaggttgaaatgcaggaaaaaatgttaagggcagccagagagaaagatcgggttacccacaaagggaagcccatcagactaacagcagctctctcagcagaaactctacaagccagaagagggtgggggtcaatattcaacattcttaaagaaaagaattttcaacccagaatttcatatccagccaaactaagcttcataagtgaaggagaaataaaatcctttacagacaagcaaatactgagagatcttgtcaccaccagaactgccttaaaagagctcctgaaggaagcactaaatatggaaaggaacaactggtactagccactgcaaaaacatgccaaattgtaaagaccattgatgttaggaagaaactgcatcaactaacaggcaaaataaccagctaacatcacaatgacaggatcaaattcacacataacaatattaaccttaaaggtaaattggctaaatgccccagttaaaagacaaagaccggcaaattgaatagagtccagacccatcagtgtgctatattcaggagacccatctcacgtgcagagacacacataggctcaaataaagggttggaggaagatctaacaaccaaacggaaaacaaaaaaaagcaggggttgtaatcctagtctctgataaaacagactttaaatcaacaaagatcaggagacaaagaaagccattacataatgataaagggatcaattcaacaagaagagataactattctaaatatatatgcactgaatacaggagcacccagattcataaggcaagtccttggagacctacaaagagacttaggctcccacacgatagtaaagggagactttaacaccccactgtcaatattagacacatccatgaaacagaaggttaacaaggatatccaggacttgaactcagctctgcaacgagcagacctaatagacatctacagaactctccacccaaaagtcaacagaatatgcattcttcttggaaccacatcacacttgttccaaaactgaccacatagttggaagtaaagccctccacaacaaatgtaaaagaacagaaataacaacaaactgtctctcagaccacagtacactgaaattagaactcaggattaagaaactcactcaaaaccacacaactacatggaaactcaacaacctgctcctgcatgactactgtgtaaataacaaaatgcaggcagaagtaaagatgttctttgacaccaatgagaacaaagacacaatataccataatctctgggacacctttaaagcagtgtgtagaaggaaatttatagtactaaatgcccacaaaagaaagcaagaaaaatctaaaatcaacaccctaacatcacaattaaaagaactagagaagcaagagtaaacacattcaaaagctagcagaaggcaagcaatacctaagattagaacagaactgaaggagatagagacacacaaaaaaacccttcaaaaaaatcaatgaatccaggagctggttttttgaaaagatcaacagcaagtattgtagaacagcaaacattgctgcctgatccttcctctggaagcttcatctcagaggggcacctggctgcatgaggtgtcagttggcccctactcagaagtgtctcccagttaggctacccaggggccagagacccacttgaggaggcagtctgtccatttcagagctcaaacaccatggtgggagaaccactgctctcttcagagctgtcagacagggatgtttaagtctgcagaagcttctgctgccttttgttcagctatgccctgccagcaaaggtggagtctacagaggtaggcaggcctccttgagctgtggtgggctccacccagttcaagcgtcctggctgctttgtttacctactcaagcctcagcaatggcgaatgcccctcccccagccagtctgcctccttgcagttggatcttggactgctgtgctagcagtgagcaaggctccatgggcatgggacccactgagccaggcatgggatgtaatctcctgggtgtgtcatttgctgagaccattggaaaagtgcagtattaaggtgggagtgtcctgattttcctggtagagtctgtcatggcttcccctggctaggaaagggaaatcccccaaccccttgcacctccggggtgaggcgatgccccgcccagcttcagcctgccttccgtgggctgcacccactgtccaaccagtcccagtgagatgaaccaggtacctcagttgaaaatgcagaaatcacccatcttctgcattgatcatgctgggagctgcagaccagagccgttcctgttcagccatcttggttcatcactatagacacgttacaaaggaagatatacaagcagccaacaagcatatgaacaaaaaggtcaatatcactgatcattagggaaatgcaaattgtaaccacagtgagataccactgatcattagataaatgcaaatcaaaaccacagtgagatactatttcacacaagtaagagtggctataattagtcaaaaaatagcagatactggtgaggttgcagagcaaagggaacatttatacactgttggtggaagtataaattagttcaaccattgtggaaagaggtgtggtgattactcaaaaagctaaaagcagaactaccatttgacccagcagtcctattactggatatatgcccaaaggaatatgtatcattctaccataaagacacatgtacatttatgttcattgcagcactgttcacaataggaaagatatggaatcacctaaatgcccatcagtggtagactggataaagaatatatggtacatatacaccatggaatactatgcagccataaaaaagactgagatcatgtactttgcaggcacatggatggagctggagaccatcatccttagcaaactaacacaggaacagaaaaccaaatgctgcatgtactcacttatgaggaggagctaactgatgagaacacatggatgcaaagagacaacagacactggggtctacttgagggtggagggttggggagaagaataggatcagaaaaaataactattgggtcctaggctttgtacctgggtgatgaagtagtctgcacagcaaactcccgtgacaggagatcagctatattagaagcctgcacttttacccctgaacctaaactataagttaaaaaaaaaaaacttaataaagaaacgtaaagtcaaaagttttgtgactattatgtcaaaattatgtgcttatcattttgctgctattccttttttaaaaaatgcatttttttctctctctgtaaaataatggtgttccctttccaatgcaaacatactttcagatcctaatcattggggtaaacattctttttaaaactactgtttacaaaagtaaaaatctgactttgtccatgcagatcatctattgacaagtatttttcaacagcataattttaaccttaagacatcagttttaatagcagtcattacattattattccaggtgattcatgggacacctgagcactctgtataattgaagttatctgtagccacatttaatatgacatgttcaatgtttggtctcacaagctcactgcttagagtcttcttcatccacccaatattgaagtaatgaaatggctgttaatagattcatcactgatctcattctgtgacatctttatcagaataatataaaatcaatgtaagaaattttgtgaaattatgaaaatttagaaaaaaataaatttcatttataaaatctgtgtgctttcattatggttttattctatttatataactcaatgtacatatattatgtttatataaaatctttttatctcattgcatatgtcttttcttccgacacaaaaattgtgatatttttctgttcatcattatgttgcatagtattcaacaatacctgtactatggctgacagtgtaatttaacattttttgataaaacaattgtaatggcatggtacacacattgtatacattttaaatcatttctcaatgtaaaatatttgaattgtctccagtgtttattttatgaatgtctgccacaaatattgaatctgaccatcgtgatttagttgttctctgtatagtttcatatgagtatattatgaagccaatgtctatgtgcatttttataatacttaatacttttccccaagtgtctgattcttttaaaatatgcaaacattatctgagaatctaatgcataatggaaaagcaagcaaatttgtgacaacaattattttatgtaagaaggaattagaggacaggctgcacaactattgacttggattggaacctaccttctgcaaatgaataacaacagctagtattagtatttatcaccattgtactaatagtcattcttgcccttgtcttccttctccacctactctcttcccccttctaatggcaccatcactttcctctattgcgaaaggggaaattttttgagaataaggttagagtgcatagaattttcattggtcctacctctgcctttgtcctttgggaaattaccacatagagcctatgcaattttcattcagcataaacattgggatttaactcgactaagatttcagttttctgttgttgctaataagaaggtagacaaaaagatctcttaagacttatataataaagtagtgaggaatgcttgctttctacttatgtctcaaaagaataacattaaagtaaaatatatgaggttcttttgtttcttcataaggaagatcatcctatatcctggcataattctttgataaatctcagtgtagttttcagatgcaagtggtagacattatttggatcttattatacatgcattgttcattttttttttggtgcttctctgtcaggcagctgtgatgatgagtcccaagtttcccagagatttttactgaggtgtcctataggcgtggcataaggcagaaaacattaaaagggtaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacacttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcgctttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggtgaagaaattcaaaatcccagtacagttgaatgagccacacttcagctttccccattgtctgaaataatgtacattaataaaataaatgtatacatatctttttatacataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtatttttttttttttttttttttttgagacggagtctcgctctgtcgcccaggccggactgcggactgcagtggcgcaatctcggctcactgcaagctccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattgtatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttgggctaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcagttaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcgaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctgaaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgttttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaaggtaagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtataggtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaatggggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttgtgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggttttctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccggttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcattcctctggaagttttgtctcagaggagttcccggccgtgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccacgtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtattttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattcagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatctgatacaatttacttagtgtttatttatggcccagcatatggtaaattcaggtaactatttcatataatctttttttttttttttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgtttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtatggtttgtcaaagatcagatggttgtagatgtgtggtgtttttctgaggcctctgttctgttccactggtctatatgtctgtctttgttccagtactatgctggtttggttactgtaaggtgtaaggaagggatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccggttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtctcccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggatttttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaataaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacagtgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaagcaatttcatacttattgttgccaaatactttaaggtgtcaaaatttgacataagggttacaaaactgtaaaccaagcccaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacgtatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggcgacacgtcttcaaaatagtgtcttcaggttttttttcctccctttccaccatttttcctagtttggagtcactgtaaactaagtcatgctttcatgaagccctacaaattaagctagacaacttaaactccagaagaaaataacagcaaccaatttacatacataatccactttcatacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaagcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgtatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagcggcacccaagtcagcagagcagacaagttttttttttttttctctaaatctacttggctaggtgggtacctccagagcagtggctagtcagactaggacattctttctctgaatggcaccctgaacagaacactaaatagacctattccaatacatgggaagtaaaaacagccagattgcttggtaagacgaagctgcatgatgcatttcaaagttttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgttttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcagaagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggggtagttttattttattttatttttttctgttcagttcttttagttaggagtcattggagccattacatgactatgagcattgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaagagagagagaaagaggaaaagaaatgtagacccataagtttcctggatatcatatcaaaattgtatactcatctttttgttgctgttgtcccttttgttcaaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttaaagcaattctcctgcctcagtctcctgagtagctgggattacaggcacctgccaccacgcctggctaatttttctgtttttagtagagacaggtttcaccatcttggccagactggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtgccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtcgcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactgaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatatattttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgtatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttatcaacccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaatacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctagtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttatgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaataatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatataccatatgactcaccaattagtgtgtacagttcaatgtttcctagtatattcacagaattttacatccactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagagtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcaggacctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcacttggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctatccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccgttccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcaatggccttgccactaaagactgacagtgccctggaacagatgtcccagcaactaccattgcttcatctgagccaagggtaaccctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccccacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccacttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttcagtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccagttacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttccccttcctgtgtccatgtgttctcattgttcaattcccacctatgagtgagaacatgtggtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgcagcaataaacatacatgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctaggtattttattctctttgaagcaattgtgaatgggagttcattcatgatttggctctctttttgtctgttattggtgtataagaatgcttgtgatttttacacattgattttgtatcctcagactttggtgaagttgcctatcagcttaaggagattttgggctgagatgatggggttttctagatatacaattatgtcatctgcaaacagggacaatttgacttcctcttttcctaattgaataccctttatttccttctcctgcctgattgccccggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcattggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaatagatgtggtgtggcgctgaaaagaatgtatattctgttgatttggggtggagagttctgtaaatgtctatcaggtcaccttggtgcagagctgagttcagttcctggatatccttgttaactttctgccttgttgatctgtctaatgtttacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttaacccatttacatttatttttaaatgtattggagtatttagcccatttacatttaaagttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaacattggtgaatctgacaattatgtgtcttggagttgctcttctcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggggagtgcctcccatttaggctactcagttgtcagagacccactggaggaggcagtctgtcctttctcagatctgcagctgcatgctgggagaaccaatactctcttcaaggccatcagacagggacacttaagtctgcagaggtttctgcttccttttatttggctatgctttgttcccagaggtggagtctacagaagcaagcaggcatccttgagttgcagttggctccacccagttcgagcttcccagctgctttgtttacctactcaagcctcagcaatgtcaggcacccctcccccagcctcgctgccaccttgcagtttgatctcagactgctgtgctaggtatgagtggggctctgtgggcataggaccctctgagccaggcatgggatgtaatctcctggtgtgccgttcactaagactgttggaaaagcgcagtattatattaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgcatcactcatgctgagagctgtagactggagctgttcctattcggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataattagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgctttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctattacttattttgacagtttgatagttttctatactgataaagtttgattattttttctttcacctttgtctgttggctgtatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatggagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccggaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctattcagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactaaaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacaatggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtacgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtactccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaaactattgacttggatttagtaacaacagtaagtattagcaattatcatgattgtactattagtcattctttcacttgtcctacttccctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctagagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacatgctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagaagtattgtttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgtgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcacttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaattttttttttttttttagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaaaataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttacgcttgtctttactttaatctcttagtcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgaaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaagatggtacctccttatatatattgacaatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgaaagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgaactatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttctttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgtctggcttccttctgcttgactccttcttatattcccttctccttcctccgttgggaggaggtgtttttctgatggttagagcagaggctttatgggaccacattttataatgcacggagtctaccctaaaagcaggattctgttccctccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccttctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggacacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgaagttgttctgcttacttttgagtaatatcggtagctgacattttctgagtactgactgtgcccaatctgctctgtgtgctgcctatattttacctcacttaattcttatcacagtcttataagggatttttttttttttttttgagacagagtatgccctatgtggcccaggctggagtgcagtggtgcgatcttggctcactgcaacctctgtttcctgggttcaagcaattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttattcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacagaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctaccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtgaggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcatgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgtttttgggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacacggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcagctgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaacctttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctatgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggcctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccatatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaaatgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagactggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagaggattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgagcaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggatgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctcaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagataaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacatgatatttaaaatatataacaattagtacaacatagggcactgaccaatcagaatagacaccagccaaactgctagagcagcttcctggatgctgtgcccttcatgtccggattatgagtacacctctggtgggctggggcagaggcatggggcaggggctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacacgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagactgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtggtgaggatgttgggaaataagaaacctcccattcaacttaagggaaagtaagctgttgcaaccattccagggagcaacatgaaagtacttggtaaattaactatctttatactttctcaatgatgtagcaattacacttctaggtttcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggagtatatagcacaacctattagaggaaatggctgaaatagtattctcttaatgtttaatgtgactattaagagggtattatgctggcatgtaaaacagttaattgtattcagtgtgttttaacatcactgattaattgatggcgtagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgcttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtgcctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaagacaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacatgaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaaaattagccgggcgtgacggcgggcgcctgtagtcccagctactcgggaggctgaggaaggagaatggcgtgaacctggaaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcactgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgtttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggaccgttggcttatttggaaaagtgtagtaataaaagagatgttcccagaagaagattgaccaattgatgaacagaaatgaaagtagagagagaacagaaattcagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccaaatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtctattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgggtcagtgatggggcgaatatgtttcatgtgtgggaagataaataaaaggggtgatgcatgaccagaaaggaggactgtggcagaaacagcctagatgctcaccaatcttatttctactgtttgggcagatggaaactgctatagttcaaagcctctcttggagttagattgcaatcatatgaatgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagccgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtaattaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccacttttttttttgaaacggagtttcactcgtgttgcctaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttcaccatgttggccaggctggtctggaactcctggcctcgtgatctgcctgcctcagcctcccaaagtgctgagattacaggcgtgagccacagtgcctggccatactttattctttatgatacaatgtctcactctgttgtccaggctggaatgcagtggcagaatcacaggtcactgcagccttgacctcctgggctaaagtaatcctctaccccagccttccaagtagctgggaccacaggtgtgcaccaccacgcctggctaatttttaaattttttgtaggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaatagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccgctcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaaaaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaaactcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcactcactaccatgcctggctaatttttgtgtttttagtagagacggggttttaccatgttggccaggctggtctcgaactcctgacctcaggtgatccacccgcctcggcctccctaagtgctgggattacaggcatgaaccaccgtgcccagccgagagatgaatattaaaacatatttgagggactttagaaattgtcagtctttaaagtctgtaagaaggatggtctggatgactcctttagcatgaactcattatttagtagatgactccatcccagttagtatttatgcctgtggaaatctcatatgaagagctagatctgatcagcagctctattatatctagcttaatgctcacaatttgttccacaaagccattctctctctctctctgtctttccctccttccattttgttagatcacatattataatagttatatgctttaaacccttatttggaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagttgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttcttcgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttgttcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggatttcctagctagtaaaatgaatgcaggaaaaagggaaaggccaagaacagtcacatctatctgtcttttcattttgtttcttcttttgcttttcatgcttagaaattctttctccgcctagagatgagatgaatattcaattatggtttcttccaattgtttctggtgctcatttttatatttatatttaacctaagataatctggaatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcctgcttgcaatgtgcatctgaagccaggaggatgtctctccaactgatcgtatatttctttcttgtttttcctttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataatttaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttatagaaagtagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatctgggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggatggagccctcagtttgtggaatctgactctatctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagttctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattgttcacagccaatgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacttgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgttccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccggtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggggtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgaggaggagctaattgctagacttgtattactacttgcaacgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctcctttctttctttctttctttcttccttccttccttccttccttccttccttccttcttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggtgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctgggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagccctgccaacatcttgaatttagtaagattactgtgacttctaatcttgtggcttttgtcggtctagtccacaggcagtaaggtttgttttgggaaaggactgttatcatctttctttcaaagctaaactataaactaagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccacttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactaaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccaccttgggcacatgtcatcaggacctcctgagactgtgtcacgggagcaagtcctcagcactggcaaacttactaaattgactgagacctgtcttagatttttggggttcacaacattcattagcgattgggggtctaggactgaaatttaaaggcatagatgaagtctgacagatccaatctgatgttaactttgggattttctttagttaccactcagtgccccagtcctccttaaaatactttatacctccaagtctctttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagtcccaatggtaaataaaccctgactgtcgttcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatactttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcctggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttgtattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgtcgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccatcctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaataaaggaagtggagaggaaggggaagggttgtctgcaatgagctagaaagttagtctttttttttttttttaaataaggaaaggaatgcgaggtggtactgataatgcctggtactgtagcgtgcctgggcattaaaggagaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaagaaaaaaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaaataacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacattcatatttattgacagcattgtttggcctcttatatatataaaatgtcatttgttttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgggcattaggccagggacatcaggcttcaagtaaatctaaaatctaggagattattctttgtagggtagaggagacgcaaaggacataggcttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatatatatataccgtgtatatatatatatatatatatataccgtgtatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggacaattttaggctattacctcctgaaatattttttccctacattctgtctaaatctattgaaaagagttacgagtgggtaggtaatttggtgactggtctcttggtatgacagcatctcattccttttggtgtcaccaactctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcatggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacggagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagtcactgcacctggcctcatttagagtttatgttatttatttatagcttgataatattttatcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgtttttttttttttttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtactttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctataatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggacattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccaacagtgtgctgtatttaggagacccgtctcacatgcagagacacacataggctcaaaataaagggatggacaaagatctaccaagcaaatagaaaacaggggttgcaaaaaagcaggggttgcaatcctagtctctgataaaactgactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccacctcaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaacaaactcactcaaaaccgctcaactgcacggaaactgaacaacctgctcctgaatgactactgggtacataacaaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcatactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaaaggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcagggcataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaaacaactccatcaaaaaatgggcaaaggatatgaacagacaattctcaaaagaagacatttatgcagccaacagacacatgaaaaagtgctcatcgtcactggccatcagagaaatggaaatcaaaaccacaatgagataccatctcacaccagttagaacagcgatcattaaaaagtcaagaaacaacaggtgctggagaggatgtggagaaataggaatgcttttacactattggtgggagtgtaaactagttcagtcattgtggaagacagtgtggtgattcctcagggatctagaactagaaataccatttgatccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacaccatggaatactatgcagccataaataaggatgagttcatgtcctttgtaggtacatggatgaagctggaaaccatcattctgagcaaactatcgcaaggagagaaaaccaaacaccgcatgttctcactcataggtgggaattgaacaatgagaacagctggacacagggcggggagcatcacacattggggcctgtcatggggttggggaagcagggagggatagcattaggagagatacctaatgtaaacgatgaattaacaggtgcagcacaccaacatggcacttgtatacatatgtaacaacctgcccgttgtgcaaatgtaccctagaagttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtgaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaaatctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaaagaaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttactttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttcttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaaatcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagaatggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttatatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatcgttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccttggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttcttttgttttcttttctattttttctattttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacaccatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtacacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttgtgatcttagaggaaacccaaaaggtgttcacttaggtctggttttaaacaggcagaacaacttattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagatcgtgccactgtactgcgccactgcactccagcctgggtgacagagcaagactctgcacccccacccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctgaattctagattctggggatagagccaaggaggacaagctgaagttctcagttttaagggactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcttaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacactttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgagggcaaagaaaggtaatcatatttatgttagtttcacaatccaagttttaaactggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaagctaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttgtttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgagacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatcttaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaagatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggttgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaacatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaacattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctatcgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaagtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttagtcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaaaggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataatcgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttctaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaactattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacagaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtatgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagagtaggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattgaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtaggtatctataagataaaacaaatctatacattgtgtttttcagctagaggcagaaactcattgtcactatatcctagataaaatcttcttgatgttattaatcctacggattaatacgaaagtgcaggaaattatcgggtcgtggaagagtcacagaaagtgcaggaaattatggggtatattttaataaaattactgaagacacatagataatatcttcacctatattataaaagtgctgagtctaggcctagcacttttcttctcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctacagtggatctacagtatataggccaagatcttatgatgcacagggcagccccctacaacaaagaattaaatggttcaatatgttagtggtgctaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacattacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaaccttgagaatgattgggagtgaacaaagtgcactgggttttggcaagaaaatacctcatgaattttgggagatatgagtttagcataaattaaaaataatgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcgtcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctactactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatgttaacaatggagtggacattatttagataacttgtggttctttcctaggcacccaactttttgctcaaagtagttaggaacaaattatcttcccaaatattattgttctaaacatatgtagtctaagattctgtatcactatctttttttttttttttttttttgagacagagtctccttgttgagacagagtctccaggctgaagtgcaatggtgcgatcttggctcactgcaacctctacctcacaggttcaagcgattctcctgcctcagcctccccagtgattgggactacaggtgcccgcctaatttttccatttttagtagagacagggtttcaccatgttggccaggctggtctcaaactcttgacctcaggtgatctgcccttctcggcctccgaaagtgctgggattacaggtgtaagccaccgcacccggtatcccccgcttttttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcctcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtatgttgtgtaattttttgtttacttttctttgaaataattatatatctacaggaagttgcaaagatagtacagaggagtcacaacatctcacccagttttctccaatgattacatctcacataactatagttcaatataagatctgggaaattgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggcttttttttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaacagtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcctagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaattttcggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccatccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccactcataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattgtggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggcatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgcttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagagtggtaggagaggtgccatacacttttaaacaatccgatctcacaagagctcactcactattgcaaagataactccaagccgtgagtgattggctcccatgacctgaacacctcgcaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccgaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcattttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaagttcttccatcctttacctgttacccagttgccaagtcgctttcacattttccaatatctttatagcaatgccacactcatagttaccaattttctgtgttaggctgttcttgcattgctattaagaaatatctgaggccgggtaatttattagaaaagatgtttaattggctcatggcttttcagactttatagtaagcctgatgctggcattaacttggctcctagggaggcatcaggaagcttataatcatggtgggaggtgaaaggggagcaggaacatcatgtggtgaaagcaggagcgagagagagagagtgggaggaggtgccacacacttttaaacaaccagatatcgtgacagttcactcgctatcgcaaagacagcactatgctgtcagggatccgttacccaaacaactcccaccagcctcacctccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttgctgtgcagaagctctttagtttaattagatcccagttgtcaatttttgttttagttgcaattgcttttagagtctttgttataaaagctttgttaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatccccagcaccatttattgattagggagtcctttccccatttcttgttatggtcagctttgtcaaagatgagatggttgtagacatgcagctttacttctggcttctctatttggttccattgatctatgtgtctattttttttgtactagcaccgtgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgatcaggctggagtgcagtgccacaactatagttcactgcagccttgaactcctgggctcaagcgatcctcccacttcagtctcctgagtagcggggactataggcattcaccaccacacatggctaattttttaggtttttggtagagatggagtcttgccatgttgctcatgctggtcttgaactcctgagctcaagcaatcctcctgcctctgcctcctaaactgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttattgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtggtgagactgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggtttcgccatgttggtcaggctggtcttgaacacttgacctcaggtgatccacacatctcggcctcccaaagtgctgggattacaggcaggagccaccgtgcccagacatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccctgttggctgtttttttaaaattactggttcaattttggaactcattatttatcttctcaggtattcaatttcttcctggttcaatattgggagtttgtgtttccaagaatttatccattccttctagattttctagtttgtgtgcatagaggtgtttacaatcatctttgaaattttttgtaaaaaatatttctcttccctttggcatttctgatggtgcttatttgaaagttctttcttttttttctttgttagtcttgctagcagtgtatcaatcttatctattctttcaaagaacaagttgtttggtttcattgatcttttatatggatttttgtgtctctatttcattcagttcagctctaattttggttatttttgtcttgtgctagtttaggggttcacttactcttgtttttctagttcctcgaggtgtgatgctacattgttaatttaagatatttatatcttttcgatgttggcattttgccccataaactttcctgttaatactgctttacctgtgtcccagaaattccggcatgttgtatctttattttcattaatttcgaagaatttcttgctttctgtcttaatttcattctttactcaaaagacattcaggagcaggctgtttaatttccatgtaattgtataattttgagagatcttggtattgatttctatttttattgcactgtggtctgagagtgtgattggtatgatttttaaaaatttgtttagaattgctttatggccaagtgcatggttgatcttagagtatgtgccatacatatgcagatgaaaagaacgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgttttttatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggcgcgatctgagctcactacatactctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaaagaatgctggctgagtataggtccccaatctcttttggcttataaggtttctgctgaaggttctgctgttatcctgatatcaccccctttgtatgtgacctgtcccttcgctctactgcttttaagattttttctttcatgttgaccttggagaatctgacgacaaggcgtctagaggatgggtgtcttgtatattatatctctggggttctctgaatttcttgaatttgtatgttgacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctgactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgccccccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtggtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaggtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatgtactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgcgttgtggaatgggagggaacgaagagttcaaacaattgactggaaaggttttattcgtctaagactttcccaaacagcaaatccttgaagggaatgagatccaggtgttagtgtacagtctagtgatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaattaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaataagtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcagatgtgcagatagatgtgatttcaacaactagactgtaaactccatgagggtggggacagtaactggttcatttttatatccttcacagttcacaggaaactataatattgtttatggcagttgttctataaagatttattaaataaaaataaagagtaataaaagcaaacaaataaatatacatgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctctctttatatctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtccctaacacaataatcagtacctctttggcgtagatgtagtcagcttaaattttacaatcacagtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatgcaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttagatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaattaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccagtcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactgcccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagcaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaaatagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcatcggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacatagacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcgtggcataaggcagaaaacattaaaaggttaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacgcttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcactttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggcaaagaaattcaaaatcccagtacgtttgaatgagccacacttcagctttccccattatctgaaataatgtacattaataaaataaatgtatacatatctttttatatataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaagtgaggtacacaaagagaaacaattttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaacattgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtattttttttttttttttttttttgagacggagtctcgctctgtcgcccaggccggactgcggactgcagtggcgcaatctcggcttccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattctatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttggactaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaactatacatgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcaattaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcaaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctggaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgctttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaagataagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtatatgtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaattgggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttatgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggtttcctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccagttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcgttcctctggaagttttgtctcagaggagttcccggccttgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccaggtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtatttttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattccagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatcttatacaatttacttagtgtttatttatggcccagcatatggtaaattcaggtaactatttcatataatctttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtctggtttgtcaaagatcagatggttgtagatgtgtggtgtttttctgaggcctctgttctgttccactggtctatatgtctgtctttgttccagtactatgctggtttggttactgtaaggtgtaaggaaggaatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccagttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtcccccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggattttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaagaaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacaatgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaaacaatttcatacttattgttgccaaatactttaaggtgtcaaaatttgacataagggttacaaaactgtaaaccaagcacaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggaaccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggctacacgtcttcaaaatagtgtcttcaggttttttttcctccctttccaccatttttcctagtttggagtcactgtaaactaagtcatgctttcataaagccctacaaattaagctagacaacttaaacttcagaagaaaataacagcagccaatttacatacataatccactttcttacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaggcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgcatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagtggcacccaagtcagcagagcagacaagttttttttttttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggagtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaaagagagagagaaagaggaaaagaaatgtagacccataagtttcctggatatcatatcaaaattgtatactcatctttttgttgctgttgtcccttttgttctaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttcaagcaattctcctgcctcagtctcctgagtagctgggattacaggcacctgccaccacgcctggctaatttttctgtttttagtagagacaggtttcaccatcttggccagagtggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtaccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtggcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactaaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatattttttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgcatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttctcatcccctcatcgtttcacctatctctgcacattattgagtactcactttaattgtcaatgagtttgggatctcttctgcatatttctttatcattgtggtctttccttataacactttttagacttttctttttcattgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaacacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttacgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaatcatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatatgccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgttggcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcagggcctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcactgggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctacccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccattccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcatcggccttgccactgaagactgacagtgccctggaacagatgtcccagcaactaccattgcttcatctgagccaagggtaactctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccgtctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttctgtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccaggtacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttctccttcctgtgtccatgtgttctcattgttcaattcccacctatgagtgagaacatgtggtgtttggttttttgtccttgtaatactttgctgagaatgatggtttccagcttcatccatgtccctacaaaggacatgaactcatcattttttatggctgcatagtattccatggtgtatatgtgccacattttcttaatccagtctatcattgttggatatttgggttggttccaagtctttgctattgtgaatagtgcagcaataaacatacgtgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctagatattttattctctttgaagcaattgtgaatgggagttcattcatgatttggctctatttttgtctgttattggtgtataagaatgcttgtgatttttacacattgattttgtatcctcagactttggtgaagttgcctatcagcttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcgttggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaataggtgtggtgtggcgctgaaaagaatgtatattctgttgatttggggtggagagttctgtaaatgtctatcaggtcaccttggtgcagagctgagttcagttcctggatatccttgttaactttctgccttattgatctgtctaatgttgacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttagcccatttacatttatttttaaatgtattggagtatttagcccatttacatttaaggttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaactttggtgaatctgacaattatgtgtcttggagttgctcttttcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggagagtgcctcccatttaggctactcagttgtcagagacccactggaggaggcagtctgtcctttctcagatctgcagctgcatgctgggagaaccaatactctcttcaaggccatcagacagggacacttaagtttgcagaggtttctgcttccttttatttggctatgctttgttcccagaggtggagtctacagaagcaagcaggcatccttgagctgcagttggctccacccagttcgagcttcccagctgctttgtttacctactcaagcctcagcaatgtcgggcacccctcccccagcctcgctgccaccttgcagtttgatctcagactgctgtgctaggtatgagtggggctctgtgggcataggaccctctgagccaggcatgggatataatctcctggtgtgccgttcactaagactgttggaaaagcgcagtattatataaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgtatcactcatgctgagagctgtagactggagctgttcctatttggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataatcagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgatttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctcttattacttattttgacagtttgatagttttctatactgataaagtttgattattttttctttcacctttgtctgttggctctatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatgaagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacaagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccagaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctatacagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactacaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacagtggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtatgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtaccccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaactattgacttggatttagtaacaacagtaagtattagcaattatcatgattgtactattagtcattctttcacttgtcctacttctctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctggagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacattctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagtattctttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgcgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcatttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaatttttttttttttttgagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaacataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttatgcttgtctttactttaatctcttaatcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgcaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaaggtggtacctccttatatatattgataatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgagagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgagctatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttttttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgcctggcttccttctgcttgactccttcttatattcccttctccttcctccgttgggaggaggtgtttttctgatggttagagcagaggctttatgggaccacattttataatgcacggagtctaccctaaaagcaggattctgttccttccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccctctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggatacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcactgcaacctccgcctcccagattcaaaagattctcctgcctcagcctcccaagtagctgggattgtaggtgcccacctccatgctcagctaattttttgtactctttttagtagagatagagtttcactatgttaaccaggctggtctcaaacgcctgagctcgtgatccacttgcctcagcctcccaatgttctgggattacaggtgtgagccaccgtgcctggcctcaacagtgttttatagttctccttgtacggacattttatcttcctggttaagtatgttcttaggtattatatttttttgcagttaaaaaagtgatggaatttttaaatttgattctcagcttggatgttattgctgtataactgtgctactgatttgtgtatattgattttgtaacctgagatgtaactaaatttgtttatcaaatctaggagtcttttgaagaaatctttagagttttctaggtatacaatcatatcataagtgaacagtgatagtttgacttcatctttttcaacttggatgtctttcatttcttttttttcccctgattgctctgactaggacttccagttctatattgaatagaagtgataaaagtgggcatccttgtcttgttccagttctcagagggaatttcagcatttccccattgagtataatgttggctgtgagtttgtcctatatggcttttattactttgaggtaagtcccttctatgcctaatttgttgaaggtatttattataaagcattgctgcatattatcaaatactttttctgcatccattgagatgattatgtggcttttgtttttaaatctgtttatgtgatgtattccatttattgacttgcatatgttaaaacatccctgtatccctgggatgaaactcacttgaccaggatgtattatctttttgaggtgctattggagtcagttagctagtattttgttgagaatttttgcatctctgttcatcagggatattagtctgtagatttttttgttttttgttatgtcatttattagtctgtagttttgttgttgttgttatatcattttctagatactggcttcacagaatgatttaggaagaattccctctttctttatttttgggaatcatttcagtgggaataattgatactaattattctctgagtgtgtggtataattcagctctgaattcttctggacctgtatattttgttgttggtggtaatttctttaatttctaattcaatcccactgttactggtctgttcagggtttctacttcttcctgatttaatctagaagggttttatgcttccaggaatttatctatttcctctaaattttttagttgtgtgtgtaacagtgatcatagtagccttgaataattttttggatttctctggtattggttgtaatacctcctgcttcattcctaattaagcttgtttggatattctctcttattttcttggttaatctcactaatggtctattaattttgtttatcttttcaaaaaaccagctttttatttcatttcacttaccttttgtattttttgttgtaatttcatttagttctgctctgatccttcctatttctttctttctgatggctttgggtttagtttgttcttgtttctagtgtttcttgagttgtgacaatatagattgtcaatttgtgctctttcagcctttttgatgtaggcatttaatgctatgaaccttagtcttagcactacttttgctgtttcccagaaattttgatcactctgtcactattatcattcattttaaataatttattaatttccatcttgatttttacccaaaaatcattgaagagcaaattacttagttttcatgtatttatatagctttgagggttctttttggagttgatttccagttttacttcactatggtctaagaagatacttgatatgattttgattttcctgattttacagagaacaattttactgatttatttatcagatctaacaatttttaaatgaaatccttgggtttttctagatattatactatgtcaaatgcaatgaagaataacttgacttatttatttccaatttgaatgcactttattttattattattattttttgctcctaattgcactaacaacatcttctggtattatgttatataagaggactgacagtgggcatctttctcttgttccagtccctaggaaacattctttaatttttttcttgttcagtatgattttagtcatggatcatatatggcctttatcattttggagaatgtttcctctaaagtcattttgatggtttggtgatctaaaaccattataatttattatatagggatttggatttttatgggctttttttagcatgtactgaaataatcctataattcttggatctgttaatacggtgggtcatgtttactgatttgcatgtattgaaacatccttccctcctcccttgcacgaattctgtgttaccctagaaaattatcttcttaatgtattattagtttggtttgcttgtattttttgaggacttttgcatctacacttgtattagtccattttgacactgctaataaagacatacctgagactgggaagaaaaagcggtttaattggacttagagttccacatggctggggaggcctcagaatcataacggaaggtgaaaggcatttcttacatagtggcggcaagagaaaatgatgaagacgtacgagcggaaatctctgataaaatcatcagagctcatgagacttattcaataccacaggaatggtatgggtgaaactgccccgtgattcaaattaactctcaccacgtccctcccacaaaaatgtggaacttttgggagtacaattcaagacgagatttgggtggggacacagagccaaaccgtataattctacccctggcccctccaaatctcatgtcctcacatttcaaaacctatcatgccttccccaatattcctcaaagtcttaaatcatttcagcattaacccaaaagtccacagttcaaagtcttatctgaggcaagacaagtcccttccacatatgagcctgtaaaatcaaaagcaagctagttacttcctagatacaatggggttactgatattgggtaaatatagccattccaaatgggagaaattggccaaaataaaggggttacaggacccattcaagtccaaaatccaccagggcagtaaaaatttaaagttccaaaatgatatcctttgactccaggtctcatatccaggtcatgctgatgcaagaggaggattccaatggtcttgggcagttcagtccctgtggccttgcagggtacagcctccaccctggctgctttcatgggctggcaatgagtgtctatggcttttccagttgcatggtccaagatgtttgtgcatgtatcattctggggtctggaggatggtggccttcttcttgctgctccaataagcagtgccctggtggggactctctgtgggggctcacagcacacattttcctttcacactgccttagcagagtttttccatgatggtctcacccctgtagcaaacttctgcctggacattcaggagtttccgtacatcttctaaaatcaaggtggaggttcccaaaccccaatttttgacatccatgtactgcaggctccataccatgtggaagctgccaaggtttgaggcttccaccctctgaagccatggtctgagttctacattggcccatttcagccacggctggagtggctgagatgaaaggcaccaagtctctagactgcacacagcatgtggaccctgagccctgcctaggaaaccatttttttctcctagacctctgggtctgtgatgggagaggctgctgcaaaggtctctgacattcctggaagacattttccccattgtcttgaggattaacattcagcttttcattactaatgcaaatacatgcagccagtttgaatttctcctcagaaaataagattttcttttctattgcattattaggctgcaaattttccaaacttttatgctctgctttcctttcaaaaaggaatgcatttaacagcacccaagtcacctcttgaatgctttgctgcttagaaatttcttctgtcagataccctaaatcatctctctcaagttcaaagtttcacaaatctctagcccggggcaaaatgccacccgtctctttactaaaacataacaagaatcacctctgctctagttcctaacaagttcctcatctctatctaagacaacctgagcctggatttcattgtccataccatttccaatacttttgtcaaagtcattcaacaagtctctatgaaattccaaactttctctcatttttctgtcttcttctgagccctccaaactgttccaatctttgcctattacccagttccaaagtcgcttctacatttttgggtatcttttcagcaatgccccaccctactagtaccaatttactctatttttctgttttcacactgttgataaagacaaaccagatactgtgaagaaaaagaggcttggccaggcgtggtgactcacacctgtaatcccagcactttgggaggccaagacgtgcagatcatgaggtcaggagattgaaaccatcctggctaacacggtgaaaccccatctctactcaaaatacaaaaaattagccagacgccttggtgggcacctgtagtcccagctactcgggaggctgaggcaggagaatgccatgaacccggggggcagagtttgcagtgagccgtgatcgcgccactgcactccaacctgggggacagagcgagactctgtctcaaaaaaaaaaaaaaaagaaaagaaagaaaaggaggcttaattagacttaaagttcctcatggctggggaggcctcagaatcagagcaggaggtgaatggcacttcttacatggtagcagcaacagaaaatgtggaagatgcaaaagtggaaaccccagataaaaccatcagatctcatgagactcattcactataatgagaacagtatggaagaaacagtccccgtgattcaaattaactcccatagggtccctcacacaacacatggaaattatgggagtacaattcaagatgatatttgggtggggacacagagccaaaccatatcaatactcatcagtgatactggcttgtagttttattgttttgttatgcccatgctttgtttttgtgtaagagtaacattatcctcatagaatgagtttgaattattcccttttttttttatttctctttttcttttcttttttttttttgaaaaggttgagtcagattggtatcaagctgttacatgttgggtataattcaaaagtgggatcataagtttctgaacctttttattttgatgaaagacattttattacttcaataacagcttcaatcccttgcccattattatttgtttgatgttttcaaccgctttatagttcaatcttagtaagttttgagtccagaaattcatatatttcttctaggtttactattaatttatcataacaattctaatagttttgtattattttggtctcagtttttatgtctcttctttttccatttctgatggtttttatttgcatcttgtctatgtttttcttgcttaacttagctaaaggtttgttaacatcattgatctttgaaacaagtcagggtcactggtctggttgtctaaggtgttatcagagcttgtgatctcaggaccaaaaaaattaagaagcgtggttacaaagggtgaggttggagcaaaaatttaataacaaaaaaacaaagctctcggcagtggagagggttccctgatggttgctgtgttacggttgtattcaaaagctcttatgaggaactgctttcatctctgtaactgagtaacttttcttatctataaaactgcctgcatagtttcatctctgtaactgagtaacttttcttatctataaaaccgcctgcatatctcccagttattctctgtcattgtggatatgtctccaggaaagcacaaagtgctgtttcttgcgtttgtataatgatgggtttgttttaggtacacccccctcctctctttgcaaattcccatggagcccactgtgtacatgtctgaaaaggggaggacactttttcctgggagcttactaatcatacaaagagcaaagggtttctatgctggacattgcatgccttgcctgcttatctgtggcttatctgtgcaggtgcactgtagctgtgattttttttttaggcaggcagcttctgcagtctgagtttttccccaagctgctctatttttcctgtagttgtgagttttcaggaaggcagcatttttgaggaccagccttaattgtttacttaactgattttctcttttcttctccatcatcttcacaaaaaaacaactttttgtttcatagatcttttgtattgtgtttattttagcctcaaatttatttaactgtgttctggtctttataatttctttctttctattagctttgggtttggtttgttcctgcttttttagttctttgatgtataggattaggttatttgaagtctttcaacttttttgatacagatgtttgttacaagaaactttcttcttacagtttttttggccatcttccatagatgttggtatgctgtacttccattttcatttgtctcacaaaatttttaaattttcttcttaataacttcattgacatgtttgtcatttagcagtatgtttaatttccatgtgttcatgtctgttttccagattcttcttttaatttattttttgttttatttcattgtggtcagaaaatatacttcatatgatacttgtgtttttgaatttgtacaggcttgtttggtagcctatcatagaattaagggagacattttttgtgctaataaaaagaatgtctattctacagcaattatgtgaaactttctgtatatgtcagttaggcccttcatatctagtgtgtactttaactctgatgtttctgtgttgattttcttcctggataatctttccattacagagaatggggtgttaaagtctcctactattgctgtgttgcatgctagttttgcctttaggtctgttaatgtttgctttacatgcttgagagctcaggttttggtaagtataatgactaaatcttgctaaactgaccccttcattatcatgtagttactgtctttgttttttgttttttttttcccgtctgatttgtaatctgtttataactacacctgtacttttctggtttctagttgcatggaatatattttgccatcccttcactttcagtctatgtatggctttataagtgaagtgggtttctttaaggcagcatgattctttattcagccattctatgtcttttaactgagaactgagacaatttacatccatttttattattgacaagtaaggcttactagagccattttgttgattgtttactgtttgtttttagactcctctcttccttccttcctgtctttcttcataattaggtgattgtctctggtagtatatttcaagttgctgctttttaagtacatcaatgatagatttcttaactgtggttaccagtagacttacagaaaaccattttagagatatggcatgttattttaaagagatcacaacttagattgcaaataaaattataaaataaataagggcaaaagtcacagaaaatgtatatactttaactcaatcacctacccattttgactcatagttatcttgatttacatatttgtatatcatctgtttcttaaccggttgctatagttgttatgttttctgggataggtgaaatgcagaacacaaattcagtactagcttattctgggtttttgcatgtactcaattttaccacttgtttttataccttgaaaagttactttttgcatgatagtgttttactctttctgactgaagagctcccattagcattttttgcaagatgggtctggtggtggagtctcaggacttttccttagttcagctaaagatgggatccttgtctgtcccatggccacaaaaatttaggctcacagatggtttgaatgtcgaggactctgaaaggccagagtccccctgctagagtgcttcctgctcaaagcttgaatcccagcttccacacagaaagaggaggggcctggctcttccccactgcaaatggcacaaacttgctgaggttccaccccagtgaacatttttctcagtgttcaagctctttggagattctctggggaccacctcctacctggctgtctctttcccccttgtaaagaagtacatctgaatgctatttgaaagagcataaggaagatcaatctttactgcttcctgctgacaaggggtgctgtttttgggaaatggtggtcagagctcactcacaggcctatctaagagttcccccagcagaaagggccattgtcagagactctgcttgcattattgtttggagtttgatgccctgaaggcaagaacagacaaactaggttattagaaaacatgtatcaaaatgaaacaaggggaggagtaaggatagctcaaaaattctgaggccttttatcactttgcacagggagagaaaggccaaaagccagactggtaaaatacccttttgctggcatgttggtcttctgggttcccttcttctgggcccaatctttagccaaccagcttaaggtttggaaagttaactctttccagtttggaagatgcatctgaggggaatgtcccagaatacggagacataattacctatccgtgaagagagaacagaggagaagaaaggaaaaagaaggcaccttttaaagaagtcccagggggtcatgatgcattcaaaatgggtacagactgaaggtgaatggctactcacctaggaagagggtggcaggtgtccctagttctcttctctttctagcagatacctggggtacatgagggagaaagagcatcctcttttcttcttccgtccttgcttccccgagtgctggtaaccttggtatgtgctgaaacaggtgtcaaagcaacatgcacccatgaaccagtggggcctagggggtgagaacattcactcttacccacttacccacatacaccctatctcccctgctttcagtagtctgggagtccctagacctcatctatgccatggatactaacaaggcttttatccatgaaccagggagcttgggcttcacttaattggcaggaaacagccacactcacctgcactgtgcattttgttgcacaaagtaggggcttatcctgccttagggactgactctttttcaggtttgatatctgcatgttttccttggcctggctcttataaaaccccacccaggaactgggttttctcctgcctgtctgcgtgtgtgttatgtgtaatgtctgcagaaagagctctaaatgattttggcctgaaaaagacaaacacttgcatctaatattttttaaagagaagttaaaaactgtggtaccgttcagttcacgtgactttaatctttgagaaataggaagaggcttaaagattaatggtaaaaagcagatgtcattacagtgtaaataggtggactaaataacgcaatggtgtctttgtccatctcagggccatgaaaatttaggctggcagatggttcaacaggtgagtaaagcagggttttattgggtgaaaaggaaaaaaaaaggggaaacagggatcttccacaaggctggagacccctgccagagtgcttcccactagcagcttgaatcccaggttccacatgggatatttgccgggctcctccctgttgcaaacagtgcaaaattcctgaggttccaccccagtgcacattcctcccagtgcacaggcttgttggagattctctggggacctccttctcctctgactagctcagtggtcaattctatgttttgtttgcctggtaaatacttcatctctcatttatatttgattgataattatttttgtttcaatattttttggtggcatccttttgtgttgagcactttgaaaacatcattccagtccttcctggtctgtatagtttcttttgggaagtctatctccataaatattggcgctgttttatatgttatttgctttcacttgctgatttcaatcttttttctttaatgtatttttttttgtcctttgtgactttgattattttgttaattggggtagtcttatttgggtttgcattgtgttctaagacctttctgtacctggacattttatgtttctcaagttttgaaaagttttttgttactatttttttgaatgagcgttctacccttgctcttactcacatctctcttgaacaccaataattcttagactgggtcttttgaagtaattttctatattttgtaggtggcacttgcttttttattctctcttgactttttaaaaataaaataacgagtcttagagctcacagattcttttctgggcttggatcattctgtggtttaagacctctaatggattttgaattcagcaaatgcatttcttagttccaagatttctgattgatttctttgtattattttaacctttttgttaaatttctcggataaatttctgaaataacttcctgtgttaacttagacattactaagttttcttaaaactgctattttgtattctgggtcagagagctcagaaattgggttatcttattagtgtcaatcactagatttttgcattgtccttttggagaggtcctggttccctgttctctgttgtttcttgtgaatatatgcatgcctttgcattgaaggattatttgttccattttttttctgtctttttttaatggaatatatttgcttagaaaatctttaccgaaaagtcactgcattcactttagttctaggtgacatgttaagcccaggtttacctcagctcatgtgaatgattagagctctgcctgtcccaagtgatgggggttccaaatggattatcctggaagtgtgagaacactgcctaagggcttgttcccagtatacctaaagaacttacatcctacagcatgctgttgctaagcaactactctgatttgaggtcaatttttggctgagttacggagaagagtttccatgtctaagaggttggtagtcctgcctctcttttttgtctctgcctgtcctcaggaatgtttctcccttcatgcactcataacatttccactgggttaaggaaagacaggtctaccagggaacttgataagatggggaagcttagtgaccatatcagtttgtctttctctcatttatataaaaattacttgacattgagtaatttataaagtaaagaggcttaattgcctcacattctgtatgctatacaggaagcatagtggcttctacctctcaggaggcctcaggaagcttgcaatcatagtggaaggcaaaagggcagtcaacacctcatatggccagagcaagaggaagggagttgtaggaggtgctacacacttttaaacaaacagatctcttgagaatgctgttacaagaacagcaccaaagggatagtgctgaatcattcatgaaagatccacctgatgatccaatcacctcccagaaaacccatctccaacactggtgattacaactgaaaatgagatttgggtggggacacagatccaaatcatattgtaaatcatgaattggagatagatattctgcgtttttggtgcagagcagagttgcaagttaggggcattattaatgtagacatagacatataattcccctacgtagtgtctactcagactttttctacttttatgacactgggaaatgtgttatcctcttaattaagcttttggttgttgtggtgtagatctcagtgccatatgtttgttttgttttgttttgcatgaagaaaaaaaggctgcttgtctctactctgccattttggaaccagaagtctcttgctccgtatattcttaataaacgtttcttatcagatatatgaattagaactttttaaattctacttatcatcagtacacttttttgatggtgtcctttcaagaacaaacatattcatttataagaatatcagtttatccattttaacttagttttttgtgactttgttgccttgtcctagaaaccattgccaaattgaagatagaaaagatttactttttctattctgggttttgtacttctgtttgttaactttgggttgttgatgtattttaaattagttctttatgtgttgtcagagaaagtgtatcttgtttttttggcctttggataatcagtctcccagaagtatttgtggaaaatattgttgttttcctattcaatagtttgacgtctttctcaaaaattaagtcaccactgtgtaaaaggatttctggattctaaaatctgttccatttatttatatggtgatctgtgttcctgtgtcacactcttataactattgatgatatgttgttggttgaaaatcggaaatgcaaggactaaattatttttcaaaatattactggttattgagattgtgccactgcactccagcctggccacagagcaagactctgtctcaaaaaaattatacatatatatatatatatatatatatatatatatatattgtgtgtgtgtatatatatatagtgtgtatatatatagtgtgtatatatatagtatatatacacacacacacgtatgtgtatgtgtgtatatatatatatatatctcgctattttttggtctcctgtatatctatattaatttagaatgagcatgtttatttctgtaaagaacccagctgggaatttaatatggattttggttaatttgtttattaattaagattttcaattgaggaatatgagattttatttattcattaagaattttattcctcaatatttagtaacttttacaatttaagttttaagtttcgcaatttattttatttttttgagatggagtctcattctgtcacccaggttggagtataatggtgccatctcagctcactacaacctccacctcccaggttcaagtgattctcctgcttcagcctcccaagtagctgggattacaggctcacgccaccacgcctggctaattttttatatctttagtagagctggggcttcaccatgttggccaggctggtctcgaacttctgacctcatggtctgcccgcctcggcctcccaaagtgctgggactacaggcatgagccactgcacctggcctaagttttgcaattcttttaatgtttttcctgtttttttaaaataatttttgattatattttatgtaggatttttgaacatgttattttcttctgtattgttcaattatgtaacaatacaattaatatttgaaggttgaccgttagtcctaaaaatgtgcttattttgttgttgatctaatattttctaggaaagtctaagatattctttacataaggtcatgccttttgtcaacaaagagagtgtacttatttcttaccttctaataaggattatttttgttttgtgttacttcctatttgctttggctggaatctccaatataatgttgaatagaagtaataagaatgaatgtctagtcttttccttattttagaaaaaaatgagttaatcttcataataggtgtctccagacaaaaagagccatgtatgaatacacacacattagtacacacctatgagggaggattttattgtaggaatttgcttaggctgagaaatattatgatatacacttacacactttatatttaggaaagctgatgctgtaattcaatctgagactgaaggccttagaactaggagaaatagttgtgtaattatttgtctgaggatgatggccttagaacttaaggagctacaagtggggtttactagtgcaaaccctagtgtccaatggcccaatatccagaagcctcaaataaagaaggcagaataatattaatgtcccagccaaagaaaagagaaatatttgtcttcttctgccttttgctctatttgggttcttaacggattggatgatacctgcccacaatcatgagagatatctttagtcagtctactgatttaaatactaatctctttttaaagtattgtaacgtttgtcacagaatcataaaaatatctatcctaaaattcatacaaaccccaaaatagccaaataaatcataaactaaaagaagaaagccagaggcatcaaattacctaatttcaaaggatattaaaagcctgtagtaactaaaacagcatggtagtagtacaaaaacagagacatagagcaatggaacagaatagagaaccaaataataaagccacacacctactgccacctgatttttaatgaagtcaggaataacaagcaatgaagaaagaaccctctattcaataaatgatgctgtgataattgtatagtcatatgcagaagactgaaatttgacctcttcctttcaccacatacagatatcaactcaaggtgtattaaatacttaaatgtaaaatctaagactatataaatatgagaagaaaacctcagaaataccatcctggatacaagccctggccaaagttttatgacaattaccccaaaaggaaattgtaacaaaaaaaaaattgacaagtgagacctaattaaactaaagaacttgtgcacagaaaaacattcaataacataaacagataacctacagaataggagaaaacatttcaatactatgcatccaacaaaggactaatgtttagaatctagaaggaacttaaacaaattaacaagcaaaaaagaaaaatcccactaaagagtggccaaaagagaacagacacttctcaagaataagtacacatggccaacaagcatatgaaaaaatactcaacattactaatcatcagagaaaagaaaatcataaaaaccactataagataccatcccccctagtcagaatgaatatcattaaaaagcacaaaatgacaggtgttggcaagattagggagaaaagaggatgctcatacactgttcgtgggaatgtaaattagttcagccactgtagaaagcagtttgaagatttttcaaataacctaaaatagaattaccattttacccatcaatcgcattactgggtatatacccaaaggactgtaagttgttctaccagaaagacacatgcacacctacgtttatcaacagcatcacagtactattcataatagcaaaaacatggaatcaatctatatgcccaacaatggtggcctggataaagaaaatatggtacacatataaatgatggaatactatgcagcaatgaaaaaaaaacaaaatcatgtctcttgagcaacacagatgcagctggaattcattaccctaggcaaattaccaccagaaaggaaaaccaaataccacatattctcagttgtaagtgggaactaaacattgagtacctatggacaaagagaaaggaataataggcaatgggaaatatgtgaaagtgtagaatgagagatctatgagaatcaaaaaactacctaccaggtactgtattaactatcttggtgatgaaataatttttacacaaaaaccctgtgacatgaaatttactcatgaagaagttgacactttaaccttctgaacctaaagtaaaatttagaggaggaaaaatgaaatgctctcacagataaatccagaaataattttttttttttttagctatttggtaatctcttaaaccagtcaagttgacacataaaattaaccatcatagttgtgcaattattttttgtggcatttatattgtgcaatatattttatggcattttcagtgcaattgtattattttatattggataattagaattatgtaaatatattgatttttatatatcaatcttttatcctgacaaggttatttatttgtttttgatctaatattttatactagatttattaagatattctctatgtaaagttgtatcatgtactgacatatgtaattgtattaacttctttttcaatatgcatgtttcttattttctgtcattgtctaattgccttagcttaaatatacaatggaatattgtcctaaaatgataaatagatctcttcatcttgttttttatcttaggtagtatttcactgatacacataataatagttttagacttttcatagctgtcttttatcagtttcatgacatttaacatcattctggttttattgaatatttttattttttattttaagtctatttctattttcagtttctgtcaattgcatatcatagttagtgtcttttgagagatttgctcattttattgagttatatgatttgttggtatgcatttgctcctagcaatgtactgtaatattttgtatttctgtatagtgtgtagtaatgtgtagtctttcatatctgattttaataatgggagtcttctcttttatgagaggtaagtctacataaatactctttgttttatttaattttgttaatcttttgaatgtaccaaattttggttttatttcctttgttgtttttattctttcatttgcttattttagcaataatcactatttcttttcttctgctttggggggtttgttcattttttctagttccttaaagtataaaattgcatattaattaaaaatttttgtctaattaatgtaggcattttaaggtcataaattgtcctctaaatattgctttttaataaattttggtgtatttgtttttaatattcttaaactttgttctgttttcttttgattttatctttgttattttgaattatgttgtttaatgtgtaatcatttgtgaatttctcaattttttaaaactgctgacattgaaggttattcctttgtattttcagaaaataacacatactatttcaatcctcttaaacttattgaggcttttccggtcaagtgatgatttgttttggaaatattaatatgcacttgataatattaaatatgtagctgctttttggagtgtgttatagttgtgtgttagagctagaagatttatagtgttcttctagtattctatttccttgttgatctttttttaaatttttgtgtatttttaagagtgaaatagagggggtgggccaagatggctgattagaagcagcagtggtccatggctctcatggagaagaatgaaaacagtgaataaattctgcaacttcaactgaggaattaaggttctcaaattgggactgacttagcagttggcacaactcagagagtgagaaaaagcggagtgggatgacagcccaccccagagtgccacaagccaggggagtccctacccccagccaaaggaggtatctctactggtgatacctccaggtgtgtgagagaccgaggctgttgctgtcagttgctatgggattgggtgaagggggatgaatggagaaatgaagacaaagacaaaaagatctgttttaaaagaaggtgtcaggggctccttgcttctagtgaacaaaggctttgagcttctacagcccttcatatttattaggtgaaaagagcagggaggaagaggtaatggttggtcagctgcttgatttatcacaggtacacataatttctttctttgtacaacaggcttcagatattcctacagataatcacaaggaacactgtgcttggggtgtgattgccctcagcactccttctgggggcagacatagtcatcagttttccaacatcctgctttcatgagaacagttttctgtttgctcatatagcctccagtggtatgctgagttggtcacgaccctcattcttttggcctgtaacatctccctctttttgttttttcattaattgaataaaggtaattgcaggttctgcagctctcaattgccatttggtggtccacctgattttgaagactatgaacaaaaaacagaaacataataacattaatccaatagtaacaacaaagacattgagttgctgtttgcggtaggtccaagggttaaggctctctaaaccttgttggaattctgcccaagcttttaaacagggctgaaacacttgagtttgcttatcgaagttaaggattttactttgtaaatcattaatatcaaaagtaacattggatgtgaaagctccctgtaaatgggcctttacaaggctccaggaatattcactttggttatattccaaattggtcacacaaatatgagtatgattaaaatgacaatgcaattgctgatgcaactgcaaactttgttatttgttctcctagccaaagaacagtagcctttaacattgccacctctgttcatatttcagcgttaattttattttgaagcatccatgcctggccagctgtgcgtgtccaattttctacatattgagctgtttgaatagagcgatgcattgctactgaggacatcacaacagaggttatcaatgtaactaaggagactatagcaacaattatcatgcctaaggctctacgagcacgatgagtaagctgagtaaaaaagagttttataagatgtaaaatgggggtggccacccaaggttcagacagatttacaggaatccataatctgggaatgcaacctagaattattagggtggatatatcatgtgtctgtattgtgctttgattaaggcaatgataaagttgacaggaatcacaagtcgactgggcatcatccacctggagttggtccttttttgctactaagaaaacgtaagaattaaagcacaaattataaattgagtggtaatattttctaccatgatcatattaaaactgcatttagcactgttattattattgaataatgtcccaactcaaatgctgccattaataaatgggagtgctgttttgcatatcgaattctggattggacctctctttccttgagaatgccattgaggcaaaggtgggctaaggcctgcgccatgccaagtaatttgcgcagcagattcggattgaatcccaatgtgacgtggcaaagagatgttaaagttttgccaccagtggcagtgaagttcatgccatgaggtctgatgctcatctctcccaaccaagtgaccatggggaccccagtcaataatgtctcccatcagcatggactgttgtctagctagggagccaagacactgggtccaaggaggggagttagaattatcaaagggaacccattctgtataattaatacaatttgggcgatgagaccaggagtgattagtaactgcactagaaatattaatagagctgaggcccaataggcacaaatattttcttttttttactattatactttacgttctagggtacatttgcacaacgtgcaggtttgttacatatgtatacatgtgccatgttggtgagctgcacccattaactcatcatttacattaggtatatctcctaatgctttccttcccccctccccccaccccatgacaggccccagtgtgtgatgttccccttcctgtgtccaagtgttctcattgttcaattcccacctatgagtgagaacatgaggtgtctggttttttgtccttgcgacagtttgctgagaatgatggtttccagcctcatccatgtccttataaaagacatgaactcatccctttttatggctgcatagtattccatggtgtatatgtgccacattttcttaatccagtctatcattgatggacatttggggtggttccaagtctttgctatcgtgaatagtgttgcaataaacatacgtgtgcatgtgaggaaagacaattttgaaaccaaagtttgattttggaaagcctttttagtatatttaaagcatttgatattgtaaaacagaattccaaattactataagtcatttattttgccaaaatgatgactcagaaacgttaaagaagcaaaaaccttttataactcttttgaatttagttaatatattcacatagataacctattctgcaagattaattttcagaatttttctaccacttgtttgaaacttcagctttttcctaatttgaaaagccaggtgtcaggaaagacaattttttaaattatactttaaattctagggtacatgtgcacaatgtgcaggtttgttacatttgtatacatggttgcgtggcacatatattttctatggtaactcaatcatgcctgggattaaattgcaaggaaactgcagttgagtgatgtatcctgggtgatgcataaaggaagtccctccaatggagcagtataattgataccattgtcctgagagtctaattgctctgtgtcagggggagttaagggtcctggtgcccatactccttgatcatgatataactcaggaggattgccagtccagagtaccggtcatactactgggaggttaagaacatatgcccaatatgtttttgcctctgcacagggaaaacatactgcacaggatattacagctgacatggccataaacttggagttaggggtttttgcctcaccctgatgctctagcagtttctcagctttttgtgtggttttcttgatctgtccccatgtctttgcattcagattcaactggctcatggctcatattggaggagctgggcccatggttgggatccatgggtccctccagtctcccattccatggtcacatacatggtgggggaacccacacagtttgtccatgtcctgtaaaaacataagcataccctcatccccacgttagtaaatctactgggcctttccattgcccttcttctggggacttctataatacctttaggtaaacttttttccctttaacatttgccactgtcattctgccggagtcttattatctgtaacaggagctaaaaaatttaaagtaaataaggctaaatgtaattttatttgaggtggtagctggtctcctactccccctttttgtttttttcaacatacactgtatgttagttacatcaattacattaataaatgtaatgcatgtttgatgtgccagctctataatgccttgtcctcagggattgtaaggaattcctgtcttatgagtaatttcccataactataaaaaattttgaaaagcatgactaacataagcaggtccattgtcagattttattggtttaggaacacccatatgggcgaatgacaataaacaatgccgctgtacatggccagctctttctgtttgacacgtagcatgtaacatatgagagtaagtgtctacagtcacatgaacacagctaagcttgccaaaggctgctatatgtgtaatacccatttgccagatttcatttggagctaagcctcgtgggttacatccttttatgggtatatcaccagggacatactggcaagtgggacaggcttgcacaatagctcgagcctggctacgaggcagatgaaacatacaagtaagggtgaggtgttttgatgcaataatgtatgaaaggcttgagcttgctgaaacacagagtcaatcaatttatctgctttgtcattgcctacagatagtggtccaggaagttgtgcgtgagagtgaatatgagaaatatgtaaaggagcagcataagaatgaataacttgctgaagtcttagaaacaagttaaacagctctggttctagggtgcttttaatagtggcagtctcaatgtgactggctacatttacaacataggctgaatcacagacaacgttaataggagttgaagcagtgagctgtaaaacctcaataactgccattaattctgagtgttgagctgaaactccagaggtttttattgtttgagtatgcttaggtccataaatagctgctcagcctttggaagagccatcagtgaaataagtctggccacctggaataggcttgtgataagtaatcacagggaggataaaagggtgaactttacaaaattgcaaaacttgcctgatggatagtggttgtctattattactacaaaatccacaagagcaatttgccaagcagtcaacatttcccatgctgcagcctgttgttggaaatccaagggaacaataattttgtctgggtcatatcctgtaaacatttttgatctatgcctatccatagttataagttgagtaattaaagaaagataaacttgtaaagattttactgtttgattggatagaaaaagccattctattaccattacaaacttgtctataaatgggcccaaaattcctattggagagtagggggttggaagaataaacagaagcaaaggcttttgtggctgtagccaggaggcatgtcttcactgaagcatttgttctacaagctgtaattcagcttctgcctccttagtaagttgccaaggagagtctaatgaagaatctccttggagggtctgataaaggtgtttgagtcgataagtagcaatacctatcatcaggcgcagccaattaatatcccctaacaattgttggaaatctttcagtgtttgtaatctgtccctacggagagttactttctgaagtcgaacacttctttcagtaacaatagtgcttaagtaccgatgtggggaggttgtttgcaccttttctggagctattttgagattccatttaatcaaagcctgttttgtttctctgaataactgatgtaaaatttgatctgtaggagtggccaaaagaatatcctccatataatgaacgatgtaagcagtaggaaacatattccgaggctcctttaatgcctgtcctacaaaatgctgacatagcacaggactgttaagcatgctttgtggtaaaactttccattgataatgagaaccaggttgtctttgatggatagaaagcacagagaaggcaaatcgaggcttatccttctcgtggaagggtatagtacagaaataatctttaagatctattactaagagaggccagtccattaaaatggctgccgcggatgccagaccttgctgtaatgcgcccattggtttaatttgtgcattaatgactcttttggaattgcaaatactggtgaattccagggactaactgactcttcgatatgttctgcatccaattgctcttttactagctgatagagttgagttagtttctcctgtgataggggccattgattcatagaggcatgggtgggacaacagattcttttaaatttttagactcagaacatgactcctgctgtccagcagaataaggagataatggcagacagacagtaagaaacaaactccaagtggagaaatcagaagggtcaactttaagacctttttgatgagctcgttttaatccttctcctattctgttccaaatttccacatcgagagtgcccatctgtggaaaccatgggttatgtacagtgaccttcttcagcatcttagttaatgtttgagaactaacctgagcaccagattgtttaagtaaaactttaagcaactgcacataatgttgctcctgaatagatagattctgccccatgttaccctgattcagaaaacttcccattcccagtacctctttagggcactaaccttatattagctgccagtagacttgtcccaaggtttcttgctcatctggtcagtttcactttctctgctccagcagaccttctttgctcatgtccctgtcctgggcaccacttgtcactgccagttgctacaggattgaatgaagggggatgaatggagaaatgaagacagagacagaaagatctgttttaaaagaaggtgacagggggctccttgtttctagtgaacaagggatctaagcttctacagcccttcgtatttataaggtagaaataggagggagggagaggtaatggttggtcagctgcttgatttatcacaggtacacttaattgctttctttgtacaacaggcttcagatacttctataggtaatcacaaggaacactgtgcttggggtgtgactgccctcagcactctttctgggggcagacacagtcatcagttttccaaatcctgctttcatgagaacagttttctgtttgctccagtggtatactgagttggtcaggaccctcattctttcagcctgtaacagagggtattagagtctggattgaaccgtagcaaacagcagtagccctatagaaggagggcttgactgttaaaagaaaaacaaacaaatagaaagctacagcaacaacatgaacaaaaaaaaaaaaaacgcccataaaaaacccgttcaaaggtcagcaacctcaacaaagttgagaaagaatcaatgcaaaaacgttgaaaatttaaaaagccagagtgcctcttcttgaaatgattgaaacaactctccagcaagggcacctaacttagccaagtctgagatggctgaatttacaaaagtcagcttcagaaggttggtaataacaaactacactgagctaaaggagcatgttataaaacaagacaaagaagctgagaatcataataaaacaatacagggctggacacagtggctaacacctgcaatccaagcaccttgggaggctgaggcagccagatcctgaggtcaggagattgagatgatcctggccaacatggtgaaaggctgtctctactaaaacacaaaaaattaaccaggtgtggtggtgcacacctgtagtctcagctactcagaaggctgaagcaggggaatcacttgaacccatgaggtggacattgcagtgagctgagatcatgccactacactccagcctggtgacagagcaagactccatctcaagaaaaatttacaggagctcaaacccagaattgctcatttaaagaggaacataaatgacccgatgaagctgagaaacacaacatgagaacttcacgacacaataacaagtattgatagccaaataaaccaagcagaggaacgaatctcagagtgtgcagactatttttctgaaataagacaggcagacaaaaatagaggagaaaagaatgaaaaggaatcaacaaaacctctgagaactatggctctatataaaaatacctatgattgattggggtacctgaaagagatagggatagtggaaccaagtttgaaagcatactttgagatataatccaggagaatgtccccaacttagcaatacagggcaacatttgaattcagaaaatccagagaaccccagcaggatgctccatgagaaaatcaacctcaagacacataatcatcagattctccaaggtcacaatgaaagaaaagtgttaagagcagccagagagaaaggccaggtcacctacaaaggaaagcccatcagactaacaacctgtcattggaaaccctacaaaccacaagatatttgggaccaatattcaacattcttaaagaagagaatttgtaacccagaatttcataaccagacacactaagctgtataagtgaaagggaaatcatattcctttcagacaagcaaatgctgaggaaattcatcaccaccaagcttgcctttcaagaactcctgagggaactactaactattgaaaggaaataccgttaccagtgactacaaaaaacacaccaaggtacacagactagtaacactataaaacaaccatgtaaacaagtctgcaaaatagccatcatgatgacaggatgaaattgacacaatattaaccataaatgtaaatggacttaacgcctcaattaaaaacacagaatggcaagctggataaagagtcaagctccatcagtatgttgtcttcaagagacctatttcacatgaaaagacacacataggctcaaaataaagggatggaggaaaatttaccaagcagaggaaaacagaaaaaaagcagtagttacaatttttgttcctgacaaaacagattttaaaccaacaaatattaaaaaaaagacattacatgatgatgagttttcaattcaacaaaaaagctaattattctaaatatatgtgtacccaataaagaagcatccagattcataaagccagttcttagagacctccaaaatgacttagactcccacacaataatagtggaagattttaacactccactgacaatattagacagatcattgagacagaaaattaacaaagattttcaggacctgaactcagctctggatcaagtagacctaatagatatctagagaactctccaactgaaaacaacagaatatacattcttctcatggctgcacggcacttactctaaaattgatcacattattggaaataaaacactcctcatcaaatgcaaaagaactgaaatcataacaaacagtctcccagaccacaatgcaaataaattataactcaacattaagaaactcaatcaaaatcacaagactatgtggaacttgtacaacatgctcctgaatgactcctgggtaaataataaaattacggcagaaattaggaagttctctgaaactaatgagaacaatgagacaacataccagaatctctcggatgcagcttaagcagtggtaagaggaaaagttagagcactaaatgccccatatcaaaaagctacaaatatctcaagtcaatgacctaacatcacaagtaaaagaactagaggaccaagaggaaaacttcccaaagctagcagaagacaagaaataaccaagatcagagcagaactgaatgagatagagacacacaaaatccttcaaaaaactcaagggattcaggagctgtatttttttttttttttgaataaaagttaacaaaatagaccgcatctgcactaataaagaagaaaacttaaaagaattaaatagacacagtcagaaatgataagggggatatcaccaatgaccccacaaatatacaaacaaccatcagagaatactttaaaaatctttagcacataaactagaaaatctagaagaaatggatacattcctggatgcacacaccctcccaagtctgaaccagggaaacattaaatccctgaataaaccaataataagttcaaaaattgaggcagtaataaatagcctaccaccaccaccaacaacaaaaatcccaggatcagatagacttacagctgaattctaacagagatactatttcttctgaaactattccaaatgatcgtaaaggagggactccaacatcaacaacaacaacaacgacaaaacttcaggccaatatccctgatgaatatcaaagcaaaaatcctctaaaatactgacaaaccaaatccagcaacacatcaataagtttatctatcacaatcaagatgacttcatcctcagaatacaagtttggttcaatgtacaaaaatcaataaatgttattcatcacataaacagatctaaagacaaaaaacacatgattatctcaatagatgcagaaaaggcctttcataaaattcagcatttcttcacattaaaaactctaaattaactaggcattaaaggaacatacctcaaaataataagagccatttatgataaatacacaaccaatatcatactgaatgggcaaaagctggaagcatttcccttgaaaaacagcccaaaaccacagtgccatctctcaccactcctattcaacattttattgaaagttttggtcaggtcaatcagttgtgagaaataaataaaagttattcaatcagaagagtggaagtaaaattatctttgtttgcagataacatgattctttatctagaaatcccattgtttcagtccaaaagcttcttaaactgagaagcaacttcattaatctcagaatacaaaatcaatgttcaaaaattggtagctttcctgtacaccaacaacaggcaagcaaagagccaaatagtaaataaacttccattcacaatagctaccatgaaaataaaatatctaagaattctactagcaagggaagtgaaggacttcttcaagaactacaaaccactgctcaaggaaatcagagaggacaccaacaaatggaaaaacattccttgatcatgggtaggaagaatcaatatcataaaaatggccacactgcccaaagtaatttatagattcaatgctgttctcattgaactaccattgacatgctttacagaattagaaaaaaaaaaaactattttaaaatgtataaggaactaaaaagtcagtagagccaagacaatcctaagcaaatagaataaagctggaggtatcatgctacctgacttcaaactatactacaaagctatagtaaccaaaacagcataatacttgtacaaaaacagacaggtagtccaatggagtagaacagagacctcagaaattacaccacacatctacaaccatctgatctttgacaaaccttgtaaaaacaatcagaaaagggtttactatttaatacatagctctgggagaactggctagttgtatgcagaaaattaaaactggaccacttcctaatactttatatgaaaactaactcaaggtggattaaagaattaaatgtaacaacaaaaactttaaaaaccctaaaagaaaatctaggtaataccattcaagtcttaggaacaagcaaagattttatgatgaaaacaccaaaagcaattacaacaaaagaaaaatggacaaatgggatctaattaaaggtctcctgcacagcaaaataaactatcatcagagtgaacagacaacatatagaaggagagaatatttttcccagttatgcatctgacaaagtacaatttcagttactttgctttatttgaaaatattttccctaaatcaaaatcttatcccttcctgaatatttgcaacattccttatatttctcacttttagaaagtatttatcttctaagtgcctactcctgaacttgttttgcagattgccttgtaattcaggcaagttgtattttgaaaaaaatctcaccagaaatttccatcaaagtagaattaagaaggaaaagatgcatgtgacaaaatagacaaacatgtttttattctattaatggtctgttaacctgcaatgaggtaaatctttcttaaaaggatattcaaacccagtttctgagaaaatattgcctgcagagtgtcaatattgttcaatgtttttattgtcgttgagtgcatgcattacgtgtcacccagattccccttttgggaatatagaaattactttccagctgatgaagtgatgaacaactgacatacctcacctataagctctctctctcagtacaaccctgctgaaagctatctagcatatagtgacctttccaagacagcccatatccaatgcctggtcacatgtaggactctaaaggcccattctccccttttcagtttggaccaactctgaaggcctaacagcttcagagctcccagtgggtgagacaaaagctatgctgagactgcatgtcttagcatgctcagggtgctatatagaaaaataccatacattggctagcttacagacaacaaacatttatttgtcacagttcttgaggctgaaagattcaccatcaagatgctggtattgggcattcctccaagatggcaactcgtcaccatgtcttaatgggggaaagagatgaatgagttattgtgagcatatttttcaaaagaattaattccattaatgaggactctgccttcatgacctaaacacctcctaaatggttctatcagctaatacagtaattttggttattataattataacttatgaattttgggggcattcagacattcagaccattgcactgaattatgtcctaatttgttccactgtccaatcctgcttcctactttttcacagatgttatttccaggaaaactctctaattatctccctcaaaaaatattcagcttagaatctacttcttcaaggcactgagcatttgataatatgtaccaagagaggtcagaaaaaaagaacagacaagaaaatgagattgtagagttggattattcactaccaagtgtaatgagaaccctatcactattggtacagagaacacaaatagcccctggaatgtgacaatttaaatttttcatacattcagtaatggtaaattatgatggaaatcttttgaggggaaaacattagttattaggatatatcacatatttatcaatatgggaacagtagaaattatgatcacaatacaggcaaatgtttttttccacagagttaaggcttgggagaaaataatagaagagtgaggactaataaccatcaaattaaggcaaatggtgaaagccagaaatgtctccttggaagtgttactggaaaaaggggtcttgatacagacatgaagtgaaggttcttggattccacacaggaaggaattcaaggtgagtcacagagtacagtgagaaaagatagtttattaaaagctatgacattacacagtagggcatcctcagaaggcaaggagttgaatgcaacacctttgttttaagtttttcttatatagaagtcttgtatctgtaaagattaattaagctgtatctagtcgtgggtggtcagacaacaggacaaaattgattattctatttattccaagaaaactatccttgacactttcctgtgtgaaaatatcaaaacatgactgttattatcttgaaagcatatatcgttatgaatattgggacatctggactcttcattgcagatgtgtgtgtttatagggagctgaacttaaaatcacattactctgactctcctacactcctgattccctaactgcagcatatacagagactctcacttcatgcagaagcacctggtccccatcaccaaatgaatctgaatcttaagtccaggactgaattttaaaaataagaccagttcagttctagctgaattcccagcctagtctgatcactaaccaggtttagggtctcagtttcgatacagtgaaattataagacatttgagaaataattcattgtagttaaaatcttcagtatctacactcccctgaactctgaatctgcaaaagtagtccattcctttctgttaagggatagcattttttcattgtttgaagatgatatagtgtcctcttccttgcaggacagtttatgtcccacctatgatttgtgcttggtatgatttcaattattttaagtcattcaggcttgcttcatgagaaagtttgttgttgatcttacaatatgttccatgtaaaaatgagtggaatgtatattacgtggttgtagggtggagtgttctgtagagctttaggtccaattggtcaagcatcaagtttaagtccagagtttctttgttaggtttttgcctcaataatctatctaatgctgtcaatgtggtgtcaactcctgccactattactgtatgattgggtaagtcttttcataggccaagaagtacttgttttataaatctgtctgcaccaatgttggatgagaacatattttggacaataaaaactgcttgttggattgtatcttttattattaggtaaagccattcattgtccttttaaatttttattcacttaaagtctgttttacataagaatagtaactccttctctttttcattttctgtttgcaggatagtttttactgtaccctttcatttcgaacctatggtataattacaggtaagatgggtctattgaatacaacatactcttgtgtctggcatatcagacactctatgtcttttaagtggtacgtttagcctgtgtacattcagtgagagtctctgtatatgctgcaaggatagtattaatatttgtgattttgatcctttcatggtgtgtttagctggttattatacagacatgactacgtagtttctttatagtgcctgtggactatgtgtttaagtgtgcttttgtggtagaaggggtaattcttttgaatctataagtagcatgcccttaaagacttcttacactgctggtctactagaaatatattctgtcggcatttgcttgccagagaagaatttttttttctctttccattagtaagtttagttcaggaggatacaaaattgttggttggaattccttttctttaaggacactgaaaacaggccccaagtctcttctggattataaacttccttgagaggtctgctgctagcttgatgggattaactctgtaggtgacctgctccttcttgaagactggttcttcaaatcaaccagtcatacaaaaataaagaaaaaaaaattaagaaaaataaagaaaacctctgagaaaatacaattatctaaaaagaccaaatctctgactcattgtctttcctgagagagaagtagagagaattagcaacttggagaatatatttgaggatatagtcaggtctactggggctcacttggggagaagtctggtaggacaacaggccacaccttcactgaaacaaccctgtggaggaacctacacaagcccgtgcatttgtgtgccccagctctccaagactgcagagagtgtagtctccttccttgttcaagtgatgagcatagccaccagcagtgcacttctaagctgcaggctacagccctggggcactgggaccctgtttgtagctcactgctgtggtcacttggggttggattttgggtgcagtgtaaaacctgaagggcttccaaagtgccagaatgcattcagatggagcaaagcactcaaactggcaaacagaggctgtactgtgtacaagcttctatggggcagccagagaggggccatggggttgagggttctggtgggccggtattcctgcagaacatatgtgtcacagttccatttgaaagtaggttctcctctctccccattggttagctaaggccagaacctattagaaatagatgtgcatggtatgtgggcacttatggttgggctccaccagaggtgacctatgcacaaaggtccctggctttttgtctgcagcttcatctctgtgtaatctctgggagacccctctgccagtccacatgtccctgaaggtatggagccccatctagccaggattccagatgtctacagtgagagggagctatctactagtcctttcactcaggtcttccctagaaactgttcagggcagagaatcagctgtattaaggcaccccattcagtgttctcagccttcttctgcttcagcctcagtgactattccttttctccatccacattcagcattttctctccaaagatctgttcaaattatgatgatatgataaaaaacctggtgttcccctggtggcagttgcacatcctgactgcatctagttgaccatcttgaacacatccctgtgtatatattcttttgagaattctctcttgatgtcccttgcccatttttttaatggagttgcttgtgtatggtttgtcaatttgtttaagttccttacagatttttgatattagacctttatcagatgagtagcttgcaattatattctcccattctgtaagtcatctgtttattctgttgatacttacttttgttgcacagaagctctttagttcaattatgttctattctcttgattttattctaggattttatacttttaggatactgtactagcctgttgtcatgctgttaataaagacatacctgagactggataatttataaaggaaagaggtttaatagattcacagttacacatggctggggtggcctcacaatcatgatgaaaggcaaatgagaagtaaagtcatgtattacatggaagcaggcaagggagcctgtgtagggaaactctcctttataaaactgtaagatctcaagagacttattcaccgtcatgagaatagcatgggaaagatgtgctaccatgattcaattaccactcaccaagttcttcccacaacatttgggaattatgggagctacaattcaagatgaaatttgggtgaggacacagccaagtcatatcattcttcccttggccccttccaaatatcaggtcctcacatttcaaaacaaatcatgcactcccatcagttccccaaagtcttagttgatttgagcattaactcaaaagtccacagtccaaagtctcatctgacataaggcaagtattttctgcctatgagtttaaaaatcaaaagcaagttagttactttctagatacaatgaggatacaggcattgggtaaataacactcctaaatggcagaaactggccgaaacataggggctacaggtcccatgcaagtccgaaatccaggtaaggcagtaaaatccaaggggcagtcacctccaaaatgatattctctgactccatgtctcacatacaggtcacactgatgtaagaggtaggctcccatggccttgggcagctcaacccctgtggctttgcagggtacagccctcctcttgggtgctttcatgggctggcattgagtgtctgtggcttttccagttgggtggtccaaactgtttgtggatatatcattctagggtctggaggatggtggccatcttctcccagctccactaggcagtgctctggtggggactctgtttgtgtgtgtgttggggtggggggctgcagggggttgctcacaccacacattttcctttcatactgccctagcagagtttctctgtgatggtctcatccctactgcaaacttctacctgaacatccaggcatttccatacatcttctgaaatctagacagaggttcccaagcctcaattattgatttctgtgtacccacaggctcaatcccacatcaaagctaataatctgccaaggcttgggggttgccccactgaaaccatggcttgaggtctaccttggccccttttagccacagctgggacacaggggaccgagtactgagactgcacaaagcagcaaggtgctgggcctggcctacaaaactattttttccttctaggcctcctagcctgtaatgggaaaggctgcagccaggaacacctctgacatgccatagagacatcttctccattgtcttggttattgacaattggtttctaattacttatgaaagtttctgcaacttgaatttctcctcagaaaatggggttttccttttatatcatatcaccaagctatgaattttccaaacttttatgctctgcctcccttttcaacataagttccaattccaaaccttatctttgtgaatatgtaaaacggaatgcttttgtctgtacccaagtcacctcttgaatactttgctgcttagaaatttcttccaccagatgccctaaatcatctctctcatgttaaaagtttcacaaatctctagggcaggaggaaagtgccaccaatctttgctaaaacataacacagtcacctttgccccagttaccaacaagttcgttatttccatctgagaccacctccgcctggactttattgtccatatcactatcagcattttggtgaaagcactcaacaagtctctagaaagtttcaaactttcacacatatttctgttttttcttctgagtcctctaaactgttccaacctctgcctgttacctagttccaaagttgcttccacattttctgatatctttacagcagtaccccactacctagtatcaatttactgtattagtctattcttatgctgttaataaagacatacccaaggctagttaatttataaaggaaagaggtttaatgggctcagagtttcacataaccaaggagacctcacaattatggcggaaggtgaatgaggagcaaagccacatcttacatggcagcaggtaagagaggttctataaactcccctttatagaacaattagatctcatgagacttatttactatcaccagaacaacatgtaaaagacccaccactatgattaaattacctcccactggatccctcccacaacacatgtaaattataggtgctacaattcaagatgagatttgggtggggacacagccaaagcatatcagttaaacatttacatctttaacccatcttcagttggtttttgcgtatggtaaaaagaagatatctagattcagtcttctgcatatggccagccagttatttcagcaccttttgttgaatagtgagttgtttctccattgcttgttcttattgactttgtttaaatcagatgactgtaggtgtactgctttatgtctgagttctttaactggttccattggtctatgtgtctatttttgtaccagaaccatgctgtttcagttactgtagccttgtattatagtttgaagttgggtattgtaagcctctggttttgttgtttgttcttagaactgttttaacttttgggctactttggtttcacaggaattttagaaaattttttttctaatttcattgaaaatgttcatggtagtttgatagaaatagcactgaatcagtaaagtattttgggcagtatggtctttttaacaatattaatttttctataattgagcatgaaacatatttctttttgttggtattgcttctaattttgtcaacagcattttgtaatgtttgggtagagatttctcacttccctggttagctgtatttctaggtatcttatctgtggctgttgtaaatggtagtgcattcttgatttggctgtcagattggaggttgttggtataaaaaaatgttactgatatttgtacacacattttgtctcccaaaactttgctgaagttgtttttcagaagtgggagcttttggacaggggctttagggttttcactgtataaaatgataactctgtgaagagagatagtttgtctttctctctttctatttggatgccttttatttttctcttttactctggctaggacttccaatactatactgaatagcagtagttagagtggccatcactgcctttttccagttctcaagaggaatcctttgagcttttgctcattcagtatgatgttgactgtgggttttcacagatggctcacactatttttgagtatttttatttaactcataatttgttcagggatttttaaaatgaaattgagatcaaacaatcattaaaaaacatcaacaaaactgaaagtttgttatctgaaagagtaaataagatggataaatcactagatagactaaaaaagaataaaaaagggatgatccaaataaacacaatcagaaatgacaaagagaagatcatcattgaccccaggaaaaacaaactacctgcaaagatcattatgaatatctctatgcacacaaacttaaaaacctagaagaagcagatatatttctggacacttacatcatctcaaagttgtaccaggtagaaatagaaatcctgaagtgacccaaaatgtgttccaaaattgaatcagtaatataaagtccagcaaacataaaaggcctgaatcagagagattcacagccaaattcttttatacatataaaaagaaatactagccatcctactgaagctatttcaaaaaattggagaggagggcctcctacttaactaattctatgaggccaagattgctctgataccaaaacctggcagagacacaggaagataagaaaatatcatgccaatatccatcatgaacatggacacaaaaatcctcaacaaagtactaactaatagaattcagcagcacatcaaaacctaaccaccacaatcaagtaggcattaatcctaggatgcaagattggttaaacatatgcaaataaataaatgtgattctccacatacataagactaaaaagaaatacaccacaatcatttcaatagatgcagcaaaggctttcaaaaaattcaacatcactttccttttttattttgaagcactctcaaaggaaacaatttaatacttctgctcaaacttcaggagatagtggtaacagactactactaagatatctccataatcttgggaaagactgtggctactacaaaatgaagcttgtgtgctggaactcccttgacagtgaatgaaagagggaatcagaaggcttatgacagtggatacattaacatagacatcctataccatgttggaaatctatagaatgtttgctgaagttataatgaatgttcaatatgtctaccctctgagggctaggtccttttggacttaccaaaccaatctcactgatatgatttatgatcagatattgaaataatagagaccttcagaaggcagatggtcaaaataaacaagagcactaagactggggtgttatccagaaagacctaatttatgaaagctgtgtatatagtaacagagaagatagcactaggggcaaaatagataggtgagcaagggaatttctcaatctataataccagaagagttcaagaatggatactaaaaagttgagggcagctgtcctcactagaaatcacagtaaattgtcaagggtctggacctaagtgtgttttcagacctgaaatttattgactgaagaagacaccagtggctccaggggaaaaaaaacagtaaactgtaaaaccaaggaaacttacatgctactgattccataatttttttttttttcctgaaatggagagtggcatccctaggataactgatgatttcctcagcctccaaaatgcataattttttagatccactttgtctttagaaaaccgtgaaattgtatcattggtgtctggatacaagtcattttagtggaaaaagccaagtggattctctttgcattagtttcctggcttcttaaaacagaagttattctctgttattcttatctctctaagccagaaggtcaaaatctgtgttctcagggttcatttgttctggaggctctaggagggaaacaaccaatgcctgtctcttggcctttattggttaccgacaattcttggaatcccgtggcttgtgacttctctccaacttctgtttcctcagcatcatcttttcttttctttcttactagttttatcctgcctttattcttttcaaaagaaactgtgtcttgctatattgacttggctgatcttgaactcctggcctcaagggatcctcctgcctttctccttataagaatatctgtcattggatttaaagcacatcgtaaatccagaataaacttgtcttgattttcttactttacttacatctgcaaagatcttttctccattaaattcactttaatagattctggaggttactcactgcacacatttttggcaaagacatctattcaattcactatatgcatgcaacttcttcattcctccattaccacagatgtcaggtgaccaagaaaatggaaaataatattgcattacatgcctggggattgtgaaaattaaagaccttaaaggtttaaaggatgcaggatgatgggctccattacatctttgattaaaagtctgaccactgcaaaatccaacagatcctagagtctggtagtggactcctgcaatttccaccaagtagttgctccactggcatcccctgttccagatggagtacctttgctagaccacatgaaaattcatattattaaaatgtctgtactcctgacagtgattaatagatttactgcaatctctattaaattcctatggtatttcttatagaattgaaaaaacttaaaatttatatgaaaacacaaaagactgttaatatgcaaacatgatttttttaaaaatgcacagaatgatcttatatattgcttttaagaaagcaactataagactttatagaaaaaatactttcttttataggttagaactgaatctactcagttttattcaagattaaatctgtccacttcttcttcacctcagaatgttaacgtttttataggattattcaaaagtaccttaattatgccctgttctgcatgcacaatccaggagacagtaagttcagagaattatagtccaacttgtttggactgacttttgttccaattttggggattggcttttggtcgttcatttcttctacggtcaaaatgtaagtggactcattttgatccatgtcatctctctcgaaagaaatatgctgtttccaaattttaaactgaacttagcttggaaaagaaggcctagtaacagagataggagttgtcattatatctctagctatcattatataatgaaagccagactttgtcaactcactcttttaccagaattttaaactccctaatagatgattgaagtgataacatgatttcctttaatgctgctcacagacttcccactttatttagaaaattcattattatagagcctgggtgatggataaagtaaggcattcacttgtttttcttatgttatagacagaagctgggtttcggtccataatatcaaaatgtcatctgttatttatattgacataactttctgaaaacagtgcaagtcaagatttgcagtgtttaatgaaacctgaattttgaaattttacctccttttgtgggaaataattttaagaatcagatatagagtttaaaatttaaagttctgtcggatctaggaaagattattttgctatatttgtgtttctctctgtgaaatttttgatcaccaattccaataaaaaccacaatagcattttctccagagatttcaatgaattctttgatttcctgtaaagaaataatttgtacatcaataagagaaatgcatcatataaatttcaaaaatagatgcatataattttaatagctttactgaaggaagaacaattgatatacaaaaaacctgcaagtatttttacttatatatttatattatttatatatatataaattgatgagttttgacatatacatgcacctatgatgctatcattacaacaatgaaggtaataaacatatccatcacctacaaaagctctctttgtcactctttgtttttgatagtaataatgcttaacatgagattgaccctcttaacacattattaagtgtacaataccgtgttgttaactataggcattatattgtagagcaaatttctatgcttattcataaacataagtgaaactttatacccactgaacaacagctccccatttctctctctcccaaacccctggaaatcactattttatttctgcttcaattagtttgcctattttacttaactaatataagtggaatcataaaatatttgtcctttttttattattatactttaagttctagggtacatgtgcacaacgtgcaggtttgttacatatgtatacatgtgccatgttggtgtgctgcactcattaactcatcttttacattaggtatatctcctaatgctatccctcccccttcccccaaccccacgacagaccccggtgtgtgatgttccccttcctgtgtccatgtgttcccattgttcaattcccacctatgagtgagaacatgcattgtttgtttttttgcccttgtgatagtttgctgagaatgatggtttccagcttcatccatgtccctacaaaggacatgaattcatccttttttattgctgcatagtattccgtggtgtatatgtgccacattttcttaatccagtctatcattgttggacatttgggttggttccaagcctttgctattgtgaatagtgccacaataaacataagtgtgcatgtgtctttatagtagcatgatttataatcctttgggcatatacccagtaatgtgatggctgggtcaaatggtatttctagttctagatccttgaggaaacaccacactgtcttccacaatggttgaactagtttacggtcctacaaagagtgtgaaactgttcctatttctccacattctctcccacacctgttgtttcctgactttataatgatcaccattctaaatggtgtgagatggtatctcattgtggttttgatttgcatttctctgatggccagtggtggtgagcactttttcatgtgtctgttggctgcataggtgtcttcttttgagaagtgtctgttcatatactttgcccactttttgatgggtttgtttgtttttttcttgtaaatttgtttgagttcactgtagattctggatattagccctttgtcagatgagtagattgtaaaaatcttctgccattctgtaggtttcctgttcactctgatggtagtttcttttgctgtgcagaagatcttcagtttaatgagatcccatttgtcaattttggcttttgttgccattgcttttagtcttttagacatgaagtccttgcccatgcctatgtcctgaatggtattgcctaggttttcttctatggtttttatagttttaggtctaacatgtaagtctttaacccatcttgaattaatttttgtgtaacatgtaaggaagggatccagtctcagctttctacatatggctagccagttttcccagcaccgtttattaaatagggaatcctttctccatttcttgtttttgtcaggtttgtccaagatcagatggttgtagatgtgtggtattatttctgagggctctgttctgttccattggtctatatctctgttttggtatcacaaccatgctgttttggttactgtagccttgtagtgtagtttgaagtcaggtagcatgatgcctccagctttgttctattggcttaggattgacttggctatgagggctcttttttggttccacatgaactttaaagtagttttttccaattctgtgaagaaagtcattggtagcttgatggggatggcatttaatctataaattaccttgggcagtgaaggcattttcacaatattgattcttcctatccatgagcatggaatattcttccacttgtttgtgtcctcttttatttcgttgagcattggtttgtagttctccttgaagaggtccttcacaacccttgtaagttggattcctaggtattttattctctttgaagcaattgtgaatgggagttcactcatgatttgactctctgtttgtctgttattgatgtataagaatgcctttgatttttgtacattgattttgtattctgagactttgctgatgttgcttatcaccttaaggagattttggactgaaatgttggggttttctaaatatacaatcatgtcatctgcaaacagggacaatttgacttcctcttttcctaattgaataccctttatttctttctcctgcttcattgccctggccagaatttacaacactatgttgaataggagtggtgagagagggcatccctgtcttgtgccagttttcaaagggaattcttccagtttttgcccattcagtatgatattggctgtgggtttgtcataaatagctcttattattttgagatacgtcccatcaatacctaatttattgagagtttttagcatgaagggttgttgaattttgtcaaaggccttttctgcatctattgagataatcatgtggtttttgtctttgtttctgttcatatgctggattatgtttattgatttgtgtatgttgaaccagccttgcatcccagggatgaagcccacttgatcatggtggataagctttttgatgtgctgctgtattcagtttgtcagtattttattgaggatttttccatcaatgttcctcagggatattggtctaaaattcttttttgttgttgtgtctctgcccggctttggtatcaggatgatgctggcctcataaaatgagttagggaggattccctctttttccattgattggaatagtttcagaaggaatggtaccagctccttcttgtacctctggtagaattcagctgtgaatccatctggtcctagaccttttttggttggtaggctattaattattgcctcaatttcagagcctgttatttgtccattcagggattcagtttctccctggttcagtcttgagagtgtgtatgtgtccaggaatttatccatttcttccagattttctagtttatttgcatagaggtgtttatagtattctctgatggtagtttgcatttctgtgggaacagtggtgatatcccatttatcattttttattgcatccatttgattcttacctcttttcttctttattagtcttgctagtggtctcccaattttgttgatcttttcaaaaaaccagctcctggattcgttgattttttgaaggctttcttgtgtctctatctccttcagttctgctctgatattagttatttcttgccctctgctagcttttgaatgtgtttgctcttccttccctagttcttttaattgtgatatttgggtgtcaattttagatctttcctgctttctcttgtaggcatttagtgctataaatttccctctacacactgctttgaatgtgtcccagagattctgttatgttgtttcatagttctcattggtttcaacaaacatctttatttctgccttcatttcttatttacccagtagtcattcaggagcaggttgttcagtttccatgtagttgagtggttttgagtgagtttcttaattctgagttctagtttgattgccttgtggtctgagagatagcttgttataatttctgttcttttacatttgctgaggagtgctttacttccaactatgtggccaattttggaataactgcaatgtggtgctgagaagaatgtatattctgttgatatggggtggagagttctgtagatgtctattaggtccgcttggtgcagagctaagttcaattcctggatatcctttttaactttctgtcttgttgatctgtctaatgttgacagtggggtgttaaagtctccagttattaatgtgtgggagtctaagtctctttgtaggttactcaggacttgctttatgaatctgggtgctcctgtattgggtgcatatatatttaggatagttagatcttcttgttgaattgatccctttaccattatgtgacagccttctttgtctcttttgatctttgttggtttaaagtctgttttatcagagactaggattgcaacatctgcctttttttgttttccatttgcttagtagatctttctccattcctttattttgagcctatgtgtgtttctgcacatgatatgggtctcctaaatacagcacactgatgggtcttgactatccaactagcaatttggataaaatatcttctaattggagcatttagcccattgacatttaaggttaatattgttatgtgtgaatttgatcctgtggttatgatgttagctggttattttgctcgttagttgatgcagtttctttctggcatcgatggtctttaaaatttgtcatgtttttgcactggctggtaccagttgttcctttccatgtttagtgcttctttcaggagctcttgtaagacaggactggtggccacaaaatctctcagcatttgcttgtctacaaagtgttttacttctccttgacttatgaagcttagtttggctggatatgacattctgggttgaaaattcttttctttaggaatgttgaatattggcccccactctcttccggcttatggagtttctgctgagagatccactgttagtctgatgggcttccctttgtgggtaacccgacctttctctctggctgcccttaatattttttccttcatttcaactttggtgaatctgacaattatgtgtatttgagttactcttcttgaggagtatctttgtggcattctctgtatttcgtgaatttgaatgttggcctgccttgctaggttggggaagttctcctggataatatcctgcagagtggtttccaacttggttccattctccctatcactttcaggtacaccagtcagacatagatttggtattttcacatagtcccatatttcttggaggctttgttcatttcattttactcttttttctctaaacttctcttctcgcttcatttcagtcatttgatcttcaatcactgataccctgtcttccagttgatcgaatcagctactgaagcttatgcatgtgtcacatagttctcctgccatggttttcagctccatcaggtcatttaaggacttctctacactggttattctagttagccctttgtctaatcttttttcaaggtttttagcttctttgtgataggttcaaactttctcctttagcttggagaagattgatcatctgaagccttcttctctcaactcttcaaagtcattctccatccagctttgttccattgctgatgaggagctgtgttcctttggagggggagaggcactgtgatttttataattttcaacttttctgctctgttttttccccatctttgtggttttatctacctttggtctttgtttatggtgacgtacagatgggattttggtgtgaatgtcttttctgtttgttagttttccttctaacgttcaggaccctcagcttcaggtctgttggagtttgctggaggtccactccagaccctgtttgcctgggtatcagcatcagaggctgcagaacggctaatattgctgaacagcaaatgttgctgcctgatcgttcctgtggaagctttgtctcagaggggtacctggccgtgtgaggtgtcagtctgcccctactgggggggtgcctcccagttaggctactcaggggtcagggacccacttgaggaggcagtctgtctgttctcagatctcaaactctttgatggggagaccactactctcttcaaagctgtcagacagggacagttaagtctgcagaggcttctgcttccttttgttcagctatgccctgccccccagaggtggagtctacagaggcaggcagccctcctgagctatggtaggctccaccttgttccaccttcctggccgctttgtttacctactcaagcctcagcaatggcgggcacccctcccccagcctcacagctgccttgcagttcaatctcagaatgctgtgctagcaatgagtgaggctccatgggcatgcgaccctccgaaccaggcatggaatataatctcctggtgttccatttgctaagactgttggaaaagcgcagtgttagtgtgggagtgacctgattttccaggtgccatctgttacagcttcccttggctaggaaagggaattccctgatcccttgtgcttcctgggtgaggagatgcctggacttgctttggctcacactccatgggttggttgcactcactgtcctgcacccactgtctgacaagccccagtgagatgaacccagtacctcagttggaaatgcagaaatcaaccatcttctgtgccgctcatgctgggagccatagactggagctgttcctattgggccatcttggaactgccccccatattagtccttcttgaacttgcttaattcacttagcataataccctctaggttcatccacattgtcacaaatggtaccttttgtcaaaccttggcaactgaattgacatttctactgcttccatatacagagaaattatactaactgaacttgtgaaaataatttattgatattaaattaaaatgctcatgaatagtttttgaattcttgtaagatcagatatggagaaaaatctcaaatttgtctttattttaatgaatgaaaaatatttatgattttgaaataattagcaatgggaaactaattaggaaaattgagatttttagattgttctactgttttgattattattgacataacataatatatcgtatatttctatatttactttaaaatacatgtttatatatacatatatatatatagacagagccatcgtgagtaaattagtgtgtatgtgtagtgggggtgtttgtgttttctttaatggatactctagcagcagttatctagtgtatgtcatgtactaattaatattgcatcccagaaacaaatcctaaaactgctttaaatttgtatcttttctctctcttctttctaagaaagaaatgtatatatggaacaatactctctgaatttgtttcattttagtataccacatgatagtgtggtgaaggagtgtgaggacaggcagacagagatgggagaaatggagagacagagagagaaagaaagaaagaaagagacagagaacttattatagtgaagccttatttatctttgtatcatgaggggctagctcaggacctggcatgaatggagcttataaagtgtatattaaaataaataggccacttatgacatgggttaagtcattcatattccaaatttaatgtaagaggttcgttctagcataaatatatatcttaggctttacaataaagtaaaatattgttacttttatacatatgatataggtttaattttgagagcacgcacaatatttatttaaaaatgctccttaaataaatttaaaaatatatttctacatgaatataatgtaacattaccaattttattgagtctctgtttttttcttataaaaagaacttacaatgataatacataagtaaaactgtaataattatacctactagacacataaaagctttgaattgaagaaaaattttacaataatctgtgtcaggttatgatttaaatttagaattactgtattctaaattctcaaacagagatcatcaatattttttagttatggtactgaattcaatagaactttaaatgtacatcatgtatgtgagctgacatagaggaatcatgattaagtaaatcaaaatagtattaatgttcaatgacatgtggtagagagaaatatttgatttttaagttagaatttaggcattcaaaacaggaatcacaggaataacaaaaggacataactctgaactatgcacaccagataagcataaaatttattttgcaaatgtttttgcagtttagtcctttgcatcagtttatattgtgggaaagtaagggagcaagaacagctgaaatgatataacacataaaaatatcagataatttttattgtaaacagatataagctgaatttgaaaacaaaattgataagaaattaaagaggaatatatttcccacttgttcctttcatatataatccaaagcctaaaattatgattctttatagaaatatcttcctgcttttctgtcatttgtcaaaagaagaataaaatcaatatttatttttagggctacattactgcatcatgaacctaaacttaattctgactctagaaaccaagtcaaaccatcaagaaatgtaaaccatgagcaaatgagaataaatgcaataaaatcacatccaatataaaaggcacggagatactacaaagagtaagaaacatcagaaagggtttaggtgaaaatataataaatattccttttctaaaatgttgtggtagtaatagtttattacttaatctacaaaaaatattgtcagtatttccatacttaccgaaatgagtatgatacctcagcctcactccttcagtatctttttaaatctattaccgtactacagtatcatttcaacaatgttaaatatttaatcacaatttaaatattaaatattaatgataaggataataatcctttactatgacctatactattcataccgttctggaaatataacatataataccagcagatcgcaagttagatagaccaaaaccctctcaaaaccaagaacaaacaaacaaaaaatacaaagcaaaacatttagcctctgcatttaaggcatgtttttcatcaatcctgatgtgctgccgggaatatacaaagaagaggtaagacatctgggattcccatgggaaaccagaaacgaatatataaatgaaatgttgagaagcccagccatcaattctccatagtaagctaaagggtcagcaaaacaaataaacttggctgcctacagcctgctgagtaactccttatttttatttgcctgccacaccatgaaagactctgcagttctaaagaagctttgtagagaaaagcaaagatatcttctgtgagggtttcttagtttactgaaagtaggagaaccttcacattaaaaggaatcagcatgatcaagcagaaggcttggtggaggtgctaacatggttatctcatatccatcaagttggagtttttctagaataacttttaaattgagtgactaaaattcatgggccagacaagtactttcccaaactttccagagtcaaagaaacacagattcagcaggaaaaaaaaaacaaaaccaaacacacacacacacacacacagaagacattcacagttttcatgaccaactcttcctttaatttacccttggtttaaaataagtacagcaagctcataagccagattcatcctaaatgtgtttcatgctttaatttctcagtcaattgatggtgaatgagtctggactttggacagcctacttattccaatagtcaaagtggaatatagctgtcctcatggaaaagatcatcaaattaagcaatatagcacaaattacataaaagctttctaaaataattttatataataggaatttatgcacttaaaattaaatacaacggaaaggatttctggttgagtctaagaaagttttccatgagatcttaattgttctaataagaagatttggattctcttctttagatttattggaatgttcatttggacatcttatttattttcactttgtttatcttaatgttgggataatagaaagcatagatattgagaatgcatactctactattggtattttttttgtcaaaatgtataatttattttgaaatgttaaatagtgcttatgggctgagtcatggctcattactcagaattcatttgtttgtgttctaaccccaagtacctcagaataggactacatttggagacagggccattatggaaaaaactaatataaaatgagggcatatagagaatatcttatatggacataaggacaaacacagagaaggaagtccatgtaaaaacactgaaggaaggcaaccatctacaaaccaatcataatggctttagaagaaaccaactctgttaatcacactttgattacacacttctagcctcctgaatgtgagaaagcatgttccttggagagaagcacaacacactgatcattagagaaatgcaaatcaaaaccacaatgagataccatctcacgccagtcagaatggtgattattaaaatgtcaagaaacaataaatgctggtgaggctgtagagaaataggaatgcttttacactgttggtgggaatgtaaattagagctaggtctttgagattatgttgattaattgatatccaatacaaaccaagttcaaagtagatgagtagttagagagagggtaaaaaatggagagttaaaaattaataaataataaagcagtctagatggtatacacactacttttaagggagcttttttttgaagtttagtgaaacttatgtaacttttaaaaatttcaattttatttgtaacttctgagtgattggttgtgttaaaaaagttaccatacaatttcccatcttaacaatttttaagtttgcaattcagcaatgttaaagtatatttacatttttgtgccacaggtttctagaaaatgttcatcttcgaaaacacattgaacaacataccattttccctttactccagcccctggtatccactattccactttctctttctatgggttttactacttttgacaccacatgtcagtgaaatcacttatatgtgtatttatctttttttgactggcttattcaacttgttataacatcctcaagcttcatcaatgttgtcacatacgatagaatagaattttccttttttacaagctaaaaaaatcattcatttcatttatataccatgttttctttgtccattcatccatccatggacatttgtgttgctttgctctcttgactattgtgaataatgttgcaaagaacatggatgtgcaaatatgtctttgagatcctacttttaattattttggataaatacctagaagtaacattgttgggtcatatggtaattttattttattttatttttttgaggaacctccataccttaactatacgggtgtcaccatttttcattcctaacaataatgcacaagagctcctatttatatatattatcttcaatactttttgttttctgggctgtgtgtgtgtgtgggggggggggtgtgtgtgtgtgtgaatatatgtattcaaaaatattttgaggtggctaatggttatgatgtgatagttcattgtaatttaggtttacatttctctaataattagtgatgttaagcatcttttcatatgctttttggccatatgtctatattttctgaataaatgtgtattcaagtctttgaattattttaattgaatttttgctattaaattatagggaattgtcatatattttgaatataaaacacttagctgataaattatttaccaatattttctttcttgcaacctatttctatggcatcagttgtaatgtcttctctttcttatttctttttgtttttggcttggtctttgttgtgtctccaggctgcagtgcagcagcagcaccatctcagctcactgaaaccctcacttcctgagttcaagcgattctctcatgtcagcctcctgagtagctgggactacaggtgcatgccaccacacctggctaatttttgtagttttagtagagacagggtttcaccatgttgcccagactggtctcccactcctgggctcaagcagtcagcctgcctcagcattccaaagtgctgggattacaggcataagccaccatgctcagcctgattttaattatacaactattcgctttttttaatcaagaaaacaatttcttgattttgttgatcttttcaaaaaaagaaagcaataactcagttttgctgatttttctctattttctattgtatttatttctgctgtaatctttattacttttttctttctgataattttggtcagttctttgatatgtaaagttagattgctttagatatttcttctttttaacataggcatttattactataaactattttcatagtattgtttttgctacatttgtaagttcaggttccttttttcacttctttttgtgtatcttctacagcaagcttgtccaacctgcagcctgacaggtgcatgcagcccaggacggctttgaatgtggcccagcacaaacttgtaaactttcttcaaacactgtgatttctcttacgattttttcccagctcatcagctatggctagtgttagtgtattttatgtgtgtccaagggcaattcttcttttcccaatgtggttcagggaaggcaaaagattgggcacccttgttctataggtgtattttgtggttaccaggaggattgcatgaagtattttataataaacattatataataaaacaaatttaaaaataaataaataaaatataaataaaataaaatataaaattaattttatataattataaaataattacaaattataaaaataaaatataaataaatattaaataaaataaacattttaaaataacagttcattttaaacaaaaaaccctttaattatacatgaaaagtctattcctttacatctcccattcctactttatgttagcaatatcactagttgtatattttgtgttgtgtcccaattaatataaatgtaatgttacttttatgcttttctcttttaaattgcatatcagaattaaaagaaacttgtgaagcaacattaaaaacttatgggattttatatttaattacatatttatctctaccagagaaatttatacttttacattcattcattttgctacctagtctccctcatttcaacttgaaagactcctttttgcttttctgtaggacaggtgtggtaataattaccttcttcaaccttttttaaacccgagaaaatattcaattttccattatttctgaatgacaggtttgccaaatgaatgtcttgtgtggtaggttttttttttcttttctgatttttctttcaacactttgaatatgttacatcacttacttttggtttaaaaagatgtctgctggtatcttgttgataataccatgtgagttcccttttatgtcatgattcatttttcttctgcttccgagattctttctttgtgacttttgaaagtttgattatgatatttattgatgcaaaatttttgaattgatctcagtgtacggtagttgtattttaaaacaattctatgtccatattcttcctcaaatttgggaattgtctgcctgccattatttctttaaatagactttttatctcaatcttttcctcttgtcccatgagggctctcataatgcataactggtcaggttaacaatgtcccataagcctccggctttcttcattttattatgagattcttcttgctcctctcccttaatagcttgaaatggccaatatttcaaattcatgaattatttttttctagctgaacaagtcatctattgaatttctctagtaaatttttcaatttagttattgtattatttacctccagaatatctatgtggttgttttctataatttttgtgtctttgttgatacttttatttcatatatgtattattttcctgatttttaaaaacttgtctatgttcttttagttaatcgagcatctttaattatttttgaaatttttgataggtatttaagatattttgaattttttgacaggtaatggatagatctttgttcattcaggattgaaaaaaggtttactttgttcctttaaacaggtcatgctttccaatgtctgcatgttttgcatttctttgtttaaattttgagatttaaagaaacacccacatctcccagtctttatgtactggcttagtgtagggaaataccttcatctatcacccctcctagagattctgggagttttgtgaaccattccaagagctgtagcctctccaggcttttgaatgtaattactaagttaaatccagtttttgtttgtttgtttgtttgttttcaggattttgtaatattttacttcacctgttgtcattctgtagtaataatgcagctcttctggtactgccctaaactgccccactgcctttattcccaggcattcaaatgctggggtttctataggtgatttaagctcagtgacagaaatcagacccttgggaagtctctaaggagccagaacattagaccacatttcaattagagcactagaatattctgaatttgtctatatatttacatttaccagtgactttttatatttttatttgttacatgttagtgtccttttcctttagagtgaaaaataccctttgcatttcttcttaaacaggtttcgtgttggtgaattctcctagttttatttgtcttgaaaagtctttatctcttcctcatatatgaagaagtgctttgatgagtacagtatttttggattaaaggtttttcaaatttttgattacttcagcatttggctatattatcccactctcttcttgcctgcaagtttgcttttttttctttctttctttttttttgttttcactgaaaattcactgaaaaccatttggtaacactattgaatgtgttatgttttgttgttgttgttttgttttgtttttctatctctcctgctgctttcagtattgtttttgttctttgatttttggtaatttgattataatgtgctttgggaattactttctgcgttgaatttgtctggtgttgtccaagctaactgttcccagatattattgtctttctccaaatttggaaaacattgagttattatattgagtttgttttctagtcctttcttttctcatatcctctagaaacttaaattatgtggaggtagttcccttcatagtgtcataaaatttctgtggccgccattctttctttttacttttatccctctgattgggtaattacatgttttctttctttgagcttactgattctttcctgtttgatcaagtctactgttaaagttttctaatgagtttttcagtttaacaattttatcctgcatttcaaggatttcatttttttattattttgatttctttctgaaatgtctaatattgtgtctgcattattttccaagtttcttttagttttttgattatggtttatgtgattcctgaacttttcaaagagatttattttgaatttgttgtcagatatttaagcatcttcgaatctttttgtgcattattgaaacttgattggtttcttttggagatgtcatatttccctgttttttttttttttttttaacaatacttgctgtttacattgatgcctgcatatttaagaagatggccacttgattcagctttttaatgtgttatgcagtggtgttaaaatattactgcttaataccagagctgaatcactaccctgagcattctttctgttctgaggatggcttatatttgatagcagaacctaaatagtgcattagagctaaatctcttccatgctgttgttttcctgtctggggaagacttatcatgaccatgaaaacacaatgctgcaccagaacttaaacccaaagccgtaataatttccgggttggggaaggcttaagaaataactagaacttagttacttacctgatagttgtttctgggtcagagaaaggctctgtatgatcacctgggttatttgtaaaatctgaccaaagattctagccttcccctggattgtgcctcctgtactactgtagtgctggctagcccccccatcaatgtgaattccctgttgataggaacacaaagcgtctgccaagatctgtttgccatttgctgtgattagtgcttctgctctttgcttccaattcaacccaggtggttcagtccttctgacactcctaatacctcctgtgggatggaaaaaagaagatttctcacaatgattcacaccctgacatggggactgagcgtccacctgcaattattttcttccacctgggtaattgcaggtacagggaagttttctgtgagtggtgctattttggtttggagaatgggttgatgcagcacaaatgacctttcttctttctggtcatggattttttaatttccatgaaccaataagatttttcacctttctcctgagctccggtgcattcagagtggtatttttatatttgaatagttgctagttgtacttttaagatggattgatgctagaggtcttcagttccaccatcttgctgatgtcactactcaaaaatatttttacatgttaggaaattattttgtttttaggattttgtgtctacgtgacacagacatgaaaagagatgtactcttatcactgaaacttttcgtatactgttttggttgtgtgcattttctagtcatgaatgattatttatttaagccatatgttttacacatagactttcttaaaaagagactagatggttctatgtgtcagaatatagagacagaatataactacacactaataatttctcaactctttattttagaagtgtaaataacctttattttaatatttttcatattacacctctgtaatgcagagaaatttttatcttcaggaaatggaaaattttgtccagagttcatgggaagatggtattgtggtgctttctctggggtcactgtttcaaaatgttacagaggaaaaggttaatatcattgcttcagcccttgcccagatcccacagaaggtcagtaaaacctccaatcctgataagtagctattcacataatgagaaagtatagcttttgcctactgatccttgctgttactggaaacaacactcttgattgtggtttgtttataataaaatagaaataataaattaagcccctacatcttattttacaatttgaaatctaaaggcatgtgccaactgttccaaaataagttctgacatttattatttccaaggaccagaaaaaagaaaactgataaaaaaaagataaagaagaatcagtctcaatctcaagaatatccttctcatatttgagtgcataaaaactgtattcatggtacttttgcatagaaataaaagctcagcttaatgtaatctttctcaataattagagtttttaagagttaaatgtcaattgcaattatattatagtaacttaattatttaagtaatgtaattatttataatactcaactgattttaactttgttactactataattccagaatttcacactttagatagtgctatatataaactatccaaaagatattttactttctatttagctaaaatacatcaaactcaataaaggcaagtacactaattaggaatgtgaaatcttgtaattttaattacaaaattatctgttaagtagtttgaaaaatctgtgccatcatttcttttcaaatgtatgacattttttataggtttcccacaattaaaaattattgaaaacaggtacaatcccaaagaaaatttatcattgaacaacggaacataagtaattctctagcttatacttcttcaataaaacagttaaatataagaaagcagaggtcagaaagaaaatagagaagaaaagacaactgattatccaaaacacacacaaaattgaaagcaaattttatctgcggggaatggtaaatttgatggtagaagtagaatagttccatggtttaaaatgacatagggatcatgtacttataaaatttttaattcttattagaaaattgagtagccagtgctgaattactttttaattattcactgatattctcattttcagatatttttgattgataataaaataataattgtatacttaataggcaacaagtacacattatctgaaaagacctttgtaaaatgtcctactatatcttttagtgtttacacagtacgtctacatacccctgtctcaaccatcacctgaagtacaatgagtgtataatttataactatatctacatacttagaatgctaatgtcctgtagttcaatctgtgaagtacatgtgtttcttccataggtgttatggaggtacaaaggaaaaaaaaccatccacattaggaaccagcactaagctgtatgattggataccccagactgaccttcttggtaggcctatgagaaagtaaaaatatgaactagatgaggaaaaatgaataaatgttaaacagtgagcaaattcagcaaatatttaaaattataaaactttattttacttatacttttgaagcagatataattaaaggattgactaaaattgtatagatagactcacactttctattgttaagatgagagtgacaggaaattcaggaggaattaatgcctctttttctgaagatagaaatgatctttactagcaatgctccatgtgctcaccttctaaagaaaatgctgtacgcttcagtgagttatctcataattcccatctttggtgctgaaattattttaaaaattcataataaaatatctcaccatttctcattcaatttgcatacaaggtcaccccaaaccaaagcttttatcactcatggtggaatgaatgggatctatgaagctatttaccatgacgtccctatggtgggagttcccatatttggtgatcagcttgataacatagctcacaggaaggccaaaggagcagctgtagaaattaacttcaaaactatcacaagcgaagatttactcagtgtttgagaacagccattaacaattcctcgtaagtactactgattgtaaagactgatctaacattgattatgttatacattatgccaggaaatgttaaatataatcctggtagacattttaagggattttcctccgcaatattaagtcattaatcaccttggtattggaatagtcctggatattatagttcatagtgtgtcaatcttcatggaaatattaggtttaagttaacaactggcttactaaacttttattcacctctttgttttaccccattttgttaagaatatactctttttcagtctccccactatatctgtttaatgctatgcaaccaataatgttcacgtcacaaccagcatcaatcttttacccaacaaatttttagcttgcataacatatactacagtttatctacctgtcttttatgaaaacaaaactacaactttctaatttctatgtgtgtttttgccttccagttacaaggaggatgctatgagattatcaagaattcaccatgatcaacccataaagaccctggatagagcagtctcctggattgagtttgtcatgtgccacaaaggagccaagcacctgcgatcagctgccaacgacctcacctggttccagcactactctatagacatgattgggttcccacgtgcctgggtggcaactgctatattcttggtctcatgatgttgtttattttcctctcaaaaatttaataaaactagaaagatagaaaagagggaacagatctttccaaatttagggaagacctgatggggtaatcctgttaattccagccacaaagactttagtgaaaacatgttcccttcctattttcatactatctattctgatattttatcttagctaagtagcctagaattccacgatcatgaagttgtgagtatatcttattgttgcattgtattttcctaggtgtccttactctcttctgtcacttattaacacaaggacattaatacatctacattttcctatttctgatatcatggtttccatgatgtcatcacttctataaccttaagtgatagggtgaccttcagtatgctgattcctggtgtttgcacaaacacatggatgtaaagaagtaaaaaatgtaaaattcacgaaattcagtaaaccacacaaatcagttaagcattctatgccttagcttgttatgagaaacataatgatttttatttttcaatttaaataagcccttctacatacccagcattactgatctcagacaatgaattgctaaaaatgacaatagagcattacactcagaatagtttgctatatttccacatacctcatctagatgtcatggcctacatttctgccatcactcaaccaacattttttgtgtgctcttgatgataaatagacagtcctcaaataataaaagaaactaataatttcttacatagagaaaatgtcaataagatattcaaggtaaccagattattttgagataagtaaccattagaaatatgtggttttaattgctgattttataaaattttagttgatggtacacttaataaagaagatttaaatgtctattctttaaaaatgatgaatacttataattcttatctctataatcaaaagtctaattaatgtagaaaaataaagagatgcttgctctgaaagtaagatcagtatacggtttttcagtctcaatcttcgagaactgcaaattcatcaagtaatggcttacatggcaaaaatttaaggtattagaatacctgcttcacaaataatagtatgtattaaatatttagatatgtaaagctgtatactaaactaaatatagtttaataatctttacacaaattaagcaaatatgttacactttttattttgtttactgttgtataaccttagtgacatgcttatttatattttaatttaaggacttgatttattaaataaataaattggctcaactggatttttgaaaatgttgaaattgttacacatgttgataaggtatatatataaattaattccagttttaaaatgactatataaaaagaaatataagtattgttcttctgtatgtacataattaaatgtaaataaaaatatttactatgtttttaacactttttaagtttttacactgatacgtttgacttttaaaatattattataatctaggaaaagctgattatagctcttttaagtctctgtaattaaatacagtaattgattaacatgctctgacaggtgagaagccatttctggagttgatcctgctgacactctgggactttttagcttggacactcattgtacgtgggactcccttcctctcaagagctgttgctcataagactctccttcatcaatctggcattgccttttaatatcagttgcaatcagaatccaactggccttgtagttgtaatatgttctatcttaaccaccactttcttaccaggagtctgcccaggtttgttctctcattcccgtaagaagctcccagcatagacattctaaatttcagatcattaagttattaacaaagctttggaccatgttcactttaggctgagcatagtgtgaggagatgtaaattaaattataatcctatatgtgcgtgttataaatattaaagtgtataaattaaataacacattctaagtgtccaacaagggtcaaataaatgatacaaagtcaccatatcaatgctatttgatctcatcttatttcagaaattttcttgtaatatcctctttggttttttatatcaattgttgcaaacaaagaaaaatctcaaaggaatttttaataattacctagagcctcacttctagacctaacaactaaaagcaaattgccatatttttatcacatagtctttaaaatttgcacatggcgtggtggcaaaattgatgttttaaaggtggcagagcaggaatgccctgtccctgttccccatgcagaaagagacttaacaacatcatatagaccaatttgccatggtgataatctcagaaaccagtgaaaaggttgcagcacctcagaaaagagcaaagccaaaaagaattttattttaatatctaggaaatgttgtaccatatactctcaatagatccttctctagaccgtacagcattacacaatcaggaaaaaaatctttagtcataacttttcccataggagtgaaagaagcgagaaatgtggtctaatgttctggctccttaggggacttcccaaggatctgattcctgtcaccgaacttaaatcacttatagaaaccccagcatttgaatgcctgggaataaaggcagtgtggctgtttagggcagtacaagaacagctgcattattactacagaatgacaacaggtgaagtaaaatattacaaaatcctgaaaacaaacaaacaaacaaaaaacccgatttaacttggcaattacatccaaaagctcagagaggatacaactcttggaatggtttgcaaagctcccaggatctctagctggggtaattgatgaaggttttccactacactaagccagtatataaagactgggagatgtggatgtttctttaaatctcagaatttaaacaaagaaatgcaaaacatgcagacactgagaagcatgacctatttaagggaacaaaataaagctttcattccaccctcaataaacaaagatttattaatcacctgtcaaaatatattaaatacctatcaaaaatttcaaaaataattaaagatgctcgattacctaaaaaaacacagacaagtttttaaaaatcaggaaaataatgcatatataaaataagagtatcaacaaagacataaaaagtatagaaaagaaccaaatagaaattctggaggtaaataatacaataattaaattgaaaaatttacaagagaaattcaatagatgacttgatcagctagaaaaaataattcatgaatttgacaatattggtgacttgaaacttttaagggagaggagcaaaaagaatgtgataataaagtgaagaaagcctgagacttatgggacattgttaacctgaccagttatgcattatgagagtcctcatgggagaagaggaaaagattgagacaaaaagtctatttaaagaaataatggcaggcagaatatttcccaaatttgaggaagaacacggacatagaattgttttgaaacacaactactgtacactgagatcagttcaaaaattttacaccaataaatattataattagtctttcaaaagtcatagacaaagaaagaatcttggaagcagaaaaagaaaaataaatcatgacataaatgggaactcacataatgttatcaacaagataccagcagatatcctttcaaaccaaagctaagcaacataatatattcaaagtgttgaagaaaaacaagaaaaaaacccaaccacataagagattcatttggcaaacctgtcattcagaaattacgcaaaatagaatattttcttgggttaaaaaaaagtttgaagaaggtaaatattaccacacctgtcctacaagcaaagcaaaaaggagtcattcatgttgaaatgagggagggtaggtagcaaaacgaatgaatgttaaaatataaatctatctggtagagataaatatataattaattataaagtcccgtaagttcttaatgttgatgcacaagttacttccaattctgatatgcaatttaaaagagaaaagcataaaagtaacattacatttggattaattgggacacaacataaaatatataactagtgatattactaacataaagtaggaatgggagatgaaaaggaatagatttttcatatataattaaagtttttgttcggtttaaaatggactgttataactagaatatgttttatgccatcctcatggtaaccacaaaatatacctataggacaagagtgtccaatcttttaccttctctggaccacattaggaaaagaagaatcaccttgggccacacacaaaatacactaacactagccatagctgatgagctgggaaaaaatcgcaagagaaatcacaatgtttgaagaaagtttacaagtttgtgctgagctgcattgaaagccatcctgggctgcatgcagctctcaggctgcaggttggacaagcttgctgtaaaagatacaaaaaaagtagtgaaaaaaaggaaactgaacttacaaaagtagcaaaaacagtactatgaggatagtttatagtaataaatgcctatgttaaaaagaagaaatatctaaaagaatctaactttacatatcaaagaactgaccaaaattatcagaaagaaaaatgtaataaagattacaacagacataaatgcaataggaaatagagaaaaatcagcaaaactgaattattgctttcttttttttgaaaagatcaacaaaattgagaaatcattttctcgactaaaaaaaacagtgaatagttgtataattaaaatcagcctgagcttgggggcttaatcctgtaatcccagcagtttggaatgccaaggcaggcagactgcttgagcacaggagtggaagaccagtctgggcaacatagtgaaaacctgtttctactaaaactacagaaattagccaggtgtggtggcatgtacctgtagtcccagctactcaggaggctgacgtgagagaatcgcttgaacttcggaagtgagggtttcagtgaccaaggtgatgctgctgctgcgctccagcctggggacagagcagagacccagtctaaaagaaaaaaaaaataacaaatcagaaatgaaagagaagacattacaattgatgtcatagaaataaataggttgcaagagagaaaatattggtaaatcacttatctgctaagtgttttatatacatatatgacaattctctatagtttaatagcaaaaacccaattaaaataattcaaagacttgaatacacgtttattcagaaaatgtagacatatggccaaaaagcatatgaaaagatgcttaacatcactaaatatttgagaaatgtaaatcaaaactacaatgagctatgacatcataaccattagccacctcaaaacatttttgaatacatatattcacacacacgcagacacacacacacacacacacacacagagcccagaaaacaaaaagtattgaagataatatatataaataggaactcctgtgcattgttggtaggaatgaaaaatgatgacagccctatagttaagagtatgaagtttcctcaaaaaaattaaaataaaattaccatatgacccaacaatgttacttctaggcatttatccaaaataattaaaagcaagatctcaaagacatatttgcacatccatgtattttgcaacattattcacaatagtcaaaagaggaaagcaacacaaatgtccacggatggatgaatggataaagaaaacatggtatatacatgaaatgaaagattatttagcttttaaaaaaagaaaattttatcatatgtaacaacattgatgaagcttgaggatgttatagtaagttgaataagccagtcaaaaaaagataaatacacatataaataatttcacatacatgtggtatcaaaactagtaaaatccatagaaagaaaaagtggaatagtggataccaggggctggagtaaagggaaaatggggtgttgttcaatgtgttttccaagatgaaaattttctagaaacctgtggcacaaaaatgtaaatatacttaacattgctcagctgcaaacttaaaaattgttaagatgggaaaatgtatggtaacttttttaacacaatcaatcactcagcagttacagagaaaattgaaagttttattttatttatttatttttgaatgttaaataacttaagtttcactaaacttcaaaaaaactcccttgaaattagtgtttttaccaaccagactctttttatttattaattttttaactcagtatgttttgttttctaattactcatctactttgaacttggtttgtgttggaaatcaatcaattaatcaacataatattaaagacctagctctaatttacgttttcaccaacagtgttaaagcattcctgtttctctatagcctcaccagcatttattgtttcttgacattttaataatcatcattctgactgacatgggatggtatctcattttggctttgatttgcatttctctaatgataagtgatgttgagcttttttccgtatgtttgttggctgcataaatgtcatcttttgagaagtggctctttatattcttcgaccagtacttaatggttttgttttttcttgtaaatttatttaagttccttgtaaattaaataaatttaattgtagataatagacctttgtcagctgggtagattgcaaaatttttctcccattctgtaggttgcctgttcactctgatggtagtttcttttgctgtgcagaagctcattagtttaattggatcccatttgtcaactttggctttcgttgcaattgtttcttgtgttttcatgatgaagtctttgcccatatctacgtcctgaatggtattgcctagattttcttctatgacttttatggttttgggttttacatttaagtctttaatcttccttgggttaatttttgtataaggtgtgaggaaggtgtccagtttcagttttctgcatgtggttacccagttttttgatcaccatttattaaatagggaattctttctccattgcttgtttttgtcagatttgtctaagattagatggttgcagatgtgtggtgttatttttgaggtgtcttttctgttccatcggtctatatacctgctttggtacaagtaccatgctgtttggttgctgttgccttttattacagttcaaagtcaggtagcacgatgtctccaattttgtttttttgcttaggattgtcttggctatacagggtgttctttgattacatatgaaattcaaagtagcttttttctaattctacgaagaatgtcaatggtagtttgatgggaatagcattgaatctataaaatactttgggcagtatggccattttcacaatgttgatttgtcctgtctgtgacgatgaaaagtgttttccatttgttttcatcctctctcatttccttgcacagtgggttgttgttctcattgaagcagttattcacatcccttgttagctatattcctaggtattttattctctttgtagcaattgttaatgggagttgattcttgatttggctctccgcttgtctattgttagggtaaaggtatccttgtgatttttgcacattgattttgtatcctgagactttgctgaatttgcttatcagtttaaggagtttgggggctgagatgacggggttttctaaatgaaaaattatgtcacctacaaacagggacaatttgacttcctatcttcctatttgaataccctttatttctttctcttgcctgactgcactagtcctaacttccaatactatgttgaataagagtgtagagagagggcatccttgtcttgtaccttttttcacagggaatgcttccagcttttgcccattcaatgtgatattggctatgcatttgtcacaaatagctcttattattttgagttatgtcccatcaatgcctagattactgagagtttttaacatgaagggatgttaaattttaccagagacctgttttgtgcatctattgagatgccatactggcagtttctcaaggatctagaaacagaaataccatttgaccctgcagtcttattactgggtatacacctaaaggaatataaatcattttgctgtgaagacacatgcagacatatgtttattgtggcactatttacagtagcaaagtcatggagctaacgtaaatgcccatcaatgacagatgagataaagaaaatgtggtacatagacaccaccaaatactgcacagccaaaaatggaatgagatcaactccttttcagagacatgaataaagctggaaaccatcatcctcagcaaactaacacaggaacagaaaaccaaacactgtgtgctctcactcataagggggagttgaacaatgaggacacatggacacagggagggaaacaacacacaccagggcctattgggaggtggagcatgagggaaggaaacttagaggatggatcaatagatgcagcaaatcaccatggcacacttatacctatgtaacaaacctgcacgttctgcacatgtatcctggaacttgtgcgtaaaaagtaaaggaaaaaaaagaagaaagaaaagaaagaaagaaagaaagaaagaaagaaagaaagaaagaaagaaagaaaagaaagaaagaaagaaaacagaaagaaagaaaagaaagcgaaagaaagagacttagctttatattatcaagtgctcaaaatatattttatattattgagcaagataatgtattaataaatttgaagtgaatggttgttactagctcaaatttatgaaaaataaaagctaatctggatacagttattcaatgtgcaaaggaataatcagaaaataaacagtatgttccaggaaccatataaggtttttttttc

SEQ ID NO: 102 - DNA, 252014 bp, Homo sapiens
tgccaaattccactttgtcattttcccattttttttttttttttacgtgtagggatcctgacttttaagatgaaaatagtgcagaattcctccctgtgcttccagatcattttctccctcctactttaaagcccagctgctttgtacatattactttataatattaccccttctcattgtacctaccttattaccttcagaaattttcttttttttaatccttctgcctgctactaatccagtcatcattcttaatactattcatcacatagacaatttattcactcgcgaggcttctaagtttctcgacttcctatatcctgagtctttttcccctctaatcattttcagacttgtttccatgattatagaccattaaggaacaacaaagatctttcaatatttctatttaaattgtcctgtcgttctaccactacctcccttctgtctatatcagtaactcctacaattcttctatttctctgacctctccagttcatagagcccataacttttatttttttaatttttttttggtctttctaggatgttatttattaaaaatagattctctgtccctaccctcacccctgctggcaaaatggcctttcccaacatcttttcctgcatggataacaggtcttgaggacgcagatgtgcatcctacctaaactacaggctcaggcttttctgggacagtgaggcagcagctctgccagagccaagggtggaacagcacaagacgacatcagcaaaccctggtgcacctaactgtgggctgctatggagtctgggatggactggagttcctcctgctccaggcctcgggagacaaaatccacaaagagagacccagtggcccagcagcagccccctgagagcccacaactttttaactcttacgctttaattcttacattcttttaattatattttaagatttaagactataatatcaaccccgattaaagccaactccccgtaggttcctatgaatggcagagttgggaggggcactaaaaaatccccgtgggaactcattcgatttatcttctgtagttgtcatagactcctcttaggttcctctacttctaatcttggcctccctcattctagccaccaacccagggtctactctcaatacagaagtcagagtgatcctttaggttagatgttgtcactcgtccactaaaccatacagtagattcccgtttcactcagagaaaagcctacagcctgcataggcctacgaggtcctcggtgatccccctccctgttgtatttcttgcctcctgtctgttcctctttcccttgcttattttttcacaacacagtggctttctggccattcctcgaatacacaaggcacacttctgccttagaacctttgctcaagctattccctttgcttggaacatccttctcccaagtatcccagtcaggcctgcaagaagcctgaattattctaccagtgacacaatcattttcctaaaaccacttttcaatttttatacattcaacaattctccattgttcaccagataaaaatgtcacctcgggagggcatttgaattttaaaacatttggaccatatcttatcttatttttgactactgagtaagataaatgttactttatcaagtgcacttcatacccttacaaaacagtcttacacaatttaatgcctgttcatacatttgttcttgcaatttctgctaccttcttcatattgttcaatacttctagtcactcaagacactactgaatgcttctttctctatgaagcaggaaatggttctatatactctattttcacagtggagtaaaatagatacacattttaggaacaaaacaaccatgcagattatagaaattaaactattttttacatactttcgaaggtgaggaagttcagaagctcaaatatggttaagatatgttttgcttctatttaagtccacattccccaccactttaaatcttccaagaaagatttccctcattcaaattaaaaacattttgatacaagactgggggcagggaagtgctgggtagagaagggcggggtccctggtgagggctccaccctcgggcctgtgcccacagacctaaatgaggacaggcgtttctgtttttgcactcaaaaagttgccttttggcccgccacgcctcccatcctgtgcccatataaacccgagaccttaagcggacacggacacaagaggctggacatctagaagagcagaagaatacagcagcagacaccggcagatcagcgatggcggaaggacacgaatgcgaggggagttcagccaggggaagtctgcgagagtcctgccactgggcagccaactgcaggggaaaaccaccgttccactccatccctcgacttctggctccccatctatctcactgagagccacttacaccacttaataaaagcttgcactcaacctttcagcccacatatgatctgattcttccagtacactggtcaagagctcaggctgtcacattggccccctgtccttgcaataagcagagggtctattgagttgactaatgcaacgagacggcagacggcatagctgaaagagtgcactgtaagtcctagacgctgccatcccttggagcccaaaagcactccccatggcctctgcacctgcccgtctgcatgctcccctaggggtttgagcactggggcaccagtgaagtgagccatccccctgtcacatgtcctgcgaggagaataagggaattctccggttttaacttaatctgtaaaagaccttgttaagaggatgaaaaagaagccacagcaatggataaaacatttgtaaactacatatccaacaaaggaatattatgactgtttcgagatttgcagaactgtctatttaacccatagactcatgagcaataataaattattattgctttaaccagtgagatttgagtgaggcttgttatacagcattactgtgcaggtgtcaattgatatactctatattgcaatatcgattcttaaattgtctaaccataatcctatagaccattactaattccaagcttgttctttttatgaagagtgtcgctcaactctgatgtctttgttctgtttaatattttgatttacacatgaacacagttcccagcagctttcaaacctccagaagcccttaacatttctgattctgaaaaatatcttttcttgttttcagcattttttattgttattttttattcttttgtatgggaaggtactcagtttaccatcctgaattagtaattctttaaacatttttgcaattccagtaattagagatattactgcattaggcattgaagataccatggtctttgcatttcctgcttgcatatcgagtcctatgaactatttctggtgtctctgagtcacttcccagtgtggtcattggcttttactgagtctgattcaccgacctttactgagcctcactcaccaacctttggtcattcttggacatagaagcacaaattcaacagtgttgtttcccaaaatatgtaatatgcagggaaaattacttttcatgtaaaatagacgtgtccttttagtattaccagtagattattctaattatagactagtaacatccaacagacttatttgggtttagtgacagacctattactgtgttcgctcctcagttcaaatacagagtgtgtattttgcatcgtgtggctgcaagttttggggttctccatcatatacttagctatacaatgccagctactcttgtctggatattttcccaaatcctggatgattacaaacttctccttcactggtgaaattttttttttttttttttttttgagatggagttttgctcttgttgtccaggctggagtgcaatggcacaatcttggctcactgcaacctctgcctcccaagttcaagtgattctcctgcctcagccttctgagtagctgggattacaggaatgtgccaccatgcccggctaatttttttttttttttttagtagagacagggtttctccatgtttgtcaggctggtctccaactcccgacctcaggtgatccacctgctttggcatcccaaagtgctgggattacaggcatgagccacagtgcctggccaatttttttttttttaatgaagggtcaaacctgatattaagtctttcagacagtaagaagataactattcagggtctacaagatggccaattagaagcagctgtggtccatggcactcagggagaggaatgaaacggggtgagtgaatttagcactgtcaattgagatattcaggttctcacactgggactgtctaggcaaacaactcaacccacagagaacaaagaaaagcagggggtgtggggcatgatggcccaccaggagcagcacagagccaaaggaacccccacccccagccaaaggaagcagtgagtgattgtgtgaccctgcccaggaaacgactcttctcccacagatctttgcaacacatggatcaggagatcccctcacaagcccacaacaacagggccttggatccagtacacagagctgcatggagtcttagcagagcagctgctcaggcacacacagagacccaggagttttacacattccagcctcaggatccccagcaaggcaggaaatctgtccacatataaccctaggaagggagctgaatccagggagccaagcagcatcattctgcaggccccacttccatagcacctcacaagttaagacgcactggcttggaattccagatagccaatagcaacagcctagaatctgcctgagataagtatgaattcctggggaaagggggtggccaccatctctgcagtccagtagacttagctgtttaagcctgccagctttggagaatacaaatggtctggatgaggaaaggttccccataatcagcacagctgccttgccagatcatggccagactgcttctttaagcaggaccttgatccatcccttctcagtgggcaggacctccctgtggaggcttcagccattctagccagtgttctacattgagagctctgatctctccctaggatggagctcctggcagggaggggcagcctccatctctgcagttcagtcaactcagtccttctagcctgttggctttgcagaatcccaaaatggtctggacgagaaagcctcctcataatgcagcacatttgctctaccaaaaagcagacagactgcttctttaatcaggcccctgatcctgttcatcccaactggatgagacctcccaacagggtctccagccacctcctacaggtgtgttctggccagcaacaggtcagtaccccccagggatggagcttccagaggaagaagctggctgccatctttgctgtttcacagccttcactgatgatacctccagtatgggaaaaaccgaggcaactaaggtctggagcggacttccagcaaaccacagcagccctacaataaagtggcctgactagtaaaggaaaaacaaaaaacagaaaacaacaagaacagtatcaatgaaaaggaccccacaaaatccaaggtcaaaggtcagcaagctcaaagattgaaggtagataagcccacaaaaatgagaaagaatcaacacaaaaatgttgaaaacttaaaaagcaagagtgccttttctcctccaaatgactgtaacacctctccagcaatggcacagaattgagctgaggctgaaatggctgaattgacagaagtagggttcagaaggtggtaataatgaactttgctgagctaaagaagcatgttgtaatccaatgcaaagaagctaagaatcatgataaaacaatacaggagctgacagccagaataaccagtttacagaggaacatgatcaacctaatggagctgaaaaatacaacacaagaccttcacaatgcaattacaagtatcagtgggagaacagaccaagtggaagaaggaatctcagagtctgaacactatctctcttaaataagaggggcagacaagaatagagggaaaagaatgaacaacaccccccagaaatttgggattatgtaaagagactgaacccatgactgactggggtacctaaaagagataaggataatggagtcaaattggaaaacatacttcaggatatgatccagaagatctttcccaacctagcaagacacaccaacattcaaattcaggaaatgcagagaaccccagtaagatactccatgagaagataaaccccaagacacataatcatcggattctccaaagttgaaatgaaaaaaaaatgttaagggcagccagagagaatggccaggccacctacaaacggaagcccatcagactaacagcagacctgtccgtggaaaccttataaagtacagtggttggaagctattctttaacattcttaaagaaaagaatctccaacccagaatttcatatctgaccaaactagcttcgtaagtgaagaagaaatacgatccttttcagacagcaaacacttaggaatttgtaccacaggactgccttgcaagagctcctctaggaagcactaaatatggaaagaagaaaaccattaccagccctacaaagcacactgaaatacacagaccagcaacactatgaagcaaccacataaacaagtctgtgaaataaccaggtagcatagtaatgacaggatccaacttacccataacaatactaacttttaagtgtaaacagggtaaatgccacaattaaaagatatagaattgcaagctgagtaaagaaccaagactcactgatatgctgtctttaggagacacatctcacatgcaaagacaaacataggctcaaaataaacggatggaagaaattttaccaaccaaatggaaaacagaaaaaagcaggggttgcaatcttagtttctgacaaaacagactttaaaccaacaaagaacaaaaaagacaaagaagggcattatataacggtaaagggttccattcaacaggaagagctagctatcctaaatatatatgcacccaatacaggagcacccagattcataaagcaagttcttagagacctacaaagagagacctggactcccacacaaaaatagtgggagactttaacaccccactgacagtattagaaacatcactgagaccaaaaactaacaaatatattcaggacccaaattcagctctggattaagtggaactgatagatatccatagaattcttcacctgaaaacatcagaatatacactcttctcatcatcatatggctgttgctcaaatcgatcacatatttggaagtaaaacattcctcagcaaatgcaaaacaactgaaatcatgacagtctctcagatcacagttcaatcaaattagaactcaagatcaagaaattcacttaaaccacacaactacatggaaattgaacaacctgctcctgaatgactcttggataaataacaaaattaaggcagaaatcaagaagttatttgaaactaatgagaacaaagagacaatgtaccagaatctctgggacagataaatcagtgttaagagggaaatgtattgcactaaaggcccactacaaacctctgctcaaagaaatgagagaagatacaaacaaatgaagaaacattccatgctcatgggtaggaagaatcaatattgtgaaaatagccatactgtacaaagtaacttatagattcaatgctattcccattaaactaccattgacgttcttcacagaattaggaaaaaaaactattttaaaattcatatggaaccaaaaaagagcctgaatagaaatagacaagacaatcataagcaaaaggaacaaagctagaggaatcatgctaccagacttcaaactatactttaaggctacaataaccaaaacagaatggtgctggtacaagagcagacacatagaccaatggaacagaatagagaactcagaaataatacgacacacctacaaccatctgatcttcaacaaacctgacaaaacaagcaatggggaaaggacttcctatttactaaatggtgttgggagagttggctagccaaatgcagaaaattgaaactggactccttccttacaccatatacaaaaattaactcaagatggattaaagacttacatgtaaaacccgaaactatgaacaccctagaagaaaacgtaggcaatctcatttaggacataggcacaggcaaagatttcatgacgaacatgccaaaagcaattgcaacaaaagcaaaaattgacaaatgcaatctaattaaactaaagagattctgcacagcaaaataaactatcatcagagtaaacagacaccctgtagaataggagaaattttttttgcaatctatctatctgaaaaaggtctaatatccagagtctgcaaggaacttaaacttacaacaaaaaaacaaccagacaaccccattaaaaagtaggcaaaggacgtgaacagacacttatcaaaagaagacatacatgtggccaagaaacatttaaaaaatagctcaacatcactgatcattagagaaatgtaaatcaaaccacaatgagattccatctcatgacagccagaatggctattataagagtcaaaaaacaatggatgctggtaaggttgcagagaaaaaggaacacttttacactgttgtgggagtgtaaatgagttaaaccactgtggaagacagtgtggtgattcctcaaaggcctagaggcagaaataccacttgacctagcaattctattatggggtacatacccaaaggaatataaatcattctattataaagatacatgcatgtgtatgttcattgcagcactgttcaccatagcaaagacatggaatcaacctaaatgcccatcagtgatagactggataaagaaaatgtggtgcatacaacatggaattatatgttggcataaaaagaaatgagatcaggctgggcacggtggctcatgcctgtaatcccagcactttgggaggccgaggtaggcagatcacgaggtcaggagattgagaccatcctagctaacacagtgaaaccccatctctactaaaaagacaaaaaattagctgagcgtggtggcgggcacctgtagtcccagctactcgggaggctgaggcaggagaatggcatgaacccgggaggcgaagcttgcagtgagctgagatcgtgccactgcactccagcctggatgacagagcaagactccatctcaaaaaataaataaataaataaataaataaataaataaatagaaatgagatcatgtcctttgcagggaaatggatagagttggaagccattacactcagcaaactaatgggaacagaaacccaaacactgcatgttctcacttataagagggagctgaatggtaagaacacatggacacatcacagggaacaagacacactagggcctgtcagaagacggttagtgggagggagagcatgaggcaagaaaaggtaatgaatgctggcttgatacctgggtgatgggatgatctgtgcagcaaaccaccatagcacatgtttacctatgtaacaaacctgcacttcctgcacaggtgccctggaacttaaaataaaagtcgaagagctccctctccctctccctctccctctccctccccctccccctccccctccccctgcctctgcctctgcctctgcctctctgtctcccctttccacggtctccctctgatgcggagctgaggctggactgtactgccgccatctcggctcactgcaacctccctgcctgattctcctgcctcagcctgccgagtgcctgggattgcaggtgcgcgccaccacgcctgactggtttttgtattttttggtggagacggggtttcgctgtgttggccgggctggtctccagctcctgaccgcgagtgatctgcctgcctcggcctcccgaggtgccgggattgcagacggagtcttgctcactcagtgctcaatcttgcccaggctggagtgcagtggtgtgatctcggctagctacaacctccaacctcccagccgcctaccttggcctcccaaagtgccgagattgcagcctctgcccggccgccaccccgtctgggaagtgaggagcgtctctgcctggccgcccatcctctgggatgtgagaagcccctctgcccggccgcccagtctgggaagtgaggagtgcctcttcccggccgtcatcccgtctaggaagtgaggagcgtctctgcccggccgcccatcgtctgagatgtggggagcgcctctgccccgccgccccgtctgggatgtggggagcgcctctgcccggccacgaccccgtctgggaagtgaggagccctctgcccagccgccaccccgtctggaggtgtacccaacagctgattgagaacgggccatgatgacgatggaggttttgtcgaatagaaaagggggaaatgtagggaaaagaaagagagatcagattgttactgtgtctgtgtggaaagaagtagacatgggagactccattttgttctgcactaagaaaaattcttctgccttgggatgctgttaatctataaccttacccccaaccccctgctctctgaaacatgtcttgtgtccactaagggttaaatggattaagggcggtgcaaaatgtgctttgttaaactgatgcttgaaggcagcatgctccttaagagtcatcaccaactccctaatctcaagtacccagggacacaaaaaccgcggaaggccgcagggtcctctgcctaggaaaccagagacccttgttcacatgtttatctgctgaccttccctccactattgtcctatgaccctgccaaatccccctctccgagaaacacccaagaatgatcaataaatactataaaaaaaataaaaaataaaaaaaataaagttgaatcaaagaaaaaaaaagtcgaagaaaaaaaaagaagataaccatttgaattgcctcatcaggtggcttgttatgggagaatgtatatttccaagactcttgaaattaaagagagtgagctatcataaacagtgagctcctagacagaaataatttagagtatgtgatagtaagcacacctgtcaaggctctctcctttgaagaaaatgtaatgaggaggactctgaaagaaattagagcatgtacacacaaagattcaaaatcaatcaacattattattacaaaagctgagagcagaattaaaagaatgcctgtgcttggaatacttgttatggagaattttaatttgctaagaaaatggatgagacactacagtattttgaagtgatacttccttctgatcatcagaacaggagcaaaggaagaatatttaaaattgaaagcttttatataattcttactgtgttttgggcatttcaagtgggttcattttccaagtagaaaatattcagcatctacttagaatgccttattttatggaagagtaaactgaagtagagagaagatacataattttcttcatgtcacatggctagtaaatggaggaaagagggattcaaacacaagaatttggggactggattccttttaaccatttataaactattataaccaaaattaaaaatataggttcattaaaatggaagaggaacaagacttccttaggaatagttctaacttcttagaagacatatttctcatatgaaagaaagaggaggttctcggccgggtgtggtggctcacacctgtaatctcagcactctgggaatttgaggcaggcggatcacttgagctcaggagtttgagacaagcctcggcaacatagtgagatcccatcactactaaaaataaaaaaaaattatctggggattggtggtgcatgcctgtggtcccagctactcgggaggctgaggtgggaaaatcacttgagcctagggggtaggggttgcagtgagccaagagcatgctactgtattccagcctaggtgacagagtgagacctcacccccaattaaaaaaaaaaagaaagaaaagaaaagaaagaaagaagaggctctcatatccaggaaagatcaattttagagggaagaggaaatgcactcagggtcaactgctctcaaggagttattagaagagatttattttggttgttactaaggcaggcaagataactggatgtaaagaatcttcatggaggaaaaacaaagatacaggatctcagaggggagactagataaactttacagaggaagacaggatttggggatttgttaaggaatgacttaaaatcaacactatataaagggttatatgcaatttggacatttttgagaagagatgccctgagacatcaattgaagactctcaaattatttgatgttcagctctagcctgtgcttgaaaggagcctgcttaattatttttaaaattatgagtcttaagaaagtgtaagaaagatggaacatattaaaggaaaagcaggcaaacaaaaaatgagaataccttttagatacaattgctcaaccaaggaaattaaagatattcaatatttatcttaatagtgcttgctttagaggatccagacattgttaattgcacatctctcaatagagaagaccacagagatcaaatctagaatattttgaaaagactagtgacaagtacaaacataaaatttaagaaggaatttaattctagtgaatattgctaatactacatgtgcttgagaaagaacaggacaaatttacaaagcctttcaaacttctagaaattcagcttaagctagaccaggcccagtggctcacgcttgtaatcccagcactttgggaggccgaggcgggtggattacctgaggtcaggagtgagagaccagcctggctaacatagtgaaacctcgtctctatgaaaaatacagaaattagcttggcatggtggcacaagcctgtaatcccagctacatgggaggctgaggcaggggaatcacttgaacccaggaggtataagttgcattgagccgagaccacgccactgcactccagcctaggcaacaaaagcaaaattccatctcaaaaagaaaaaaaaaaaaagtagtgagccaactctttattcagtaggggatcctgtccgctaaggaaaaggtaatggaagggcatattcgattcaggagaatgctagctagcccaataagctgcaaagctcagccccttctttaccagaatcaaagctcacatttccacttcagttgatctgacatgagtatttttctctcaggtgttttgaatcttaggtcagaaagagtggttacccctgcgcatgaccactgtgccaatgtaacacagcatatattactttgggtcttgacaaagggctcatttttagtgactgagtccttctggccaccaggagacacttcagtgccacaaccactcactgacactttagagttgctaagaggactgtcaggccatgggaaactaagaagaagctcaggcttggtacctgaatcatgagtcctacctgttgagcactgaaaaagcactggaaagagaagggaggacccaaaaacttctaaacctgtgcgaatgggctaagaccaatagtgaggttgggattttaggcaagtttgggatggttgtcagacaaagaagccactgatataccactagtacaatgcagttcgaattacaataaaaagttatagggggtttttttgggtcagaaagagaagaagtaaaagagcacacatgattcctatctccttttatcctccaaactaactctcactaacccacagaaatgttttcataggtggcacaaaggtaggctgcaacaattgtggccaatattatggtagagaaggaccctgccctgtaatgctcaacatattaatgttacgtgagagtgggacagggtcatctctgtgacagtatagtcacagaagcctcttcctgctcaaataagtggccttcattaaaagaaacacagaagaatcttgtttcataagctaatgccaatcactgagacagcaacggtttcaggaacatgagggaagctgttggaatgggctttcctttaaacctagcctggttccatcatgctgagtggtgggggctttaagtcagggcctgagaaggacagcctaactgtggtataagtcagagggctcctcattcctcataagccgacaaatacattaatatcatcagaaaaattaccagggcctgtggtgtcccaaattctgatttcattttccattgaagatcagagcacagaggaaggagatacctcactcatgtgctcttcttgttatatgctcacagtttctttgtttcaatgactctgtaccctggaagaggttagacctggatatgctaaaaaaaaatttttttaatccctatcctagaatattgtggccttgaatcaaagtgttttctatgtttgtgttttcatcttccttcctaagccctatatctaggttttgccttctccatccacaaatctcaggatgctatggagtctgaagacacctgattgcagaaagcacaagaccccccaccagcgcgcgcacatacacaaacaaatacaggaccagaaaggagtggttactgctgattctctaacattacaaaaatatcacggttgtaacttctcaccctgccagtcatatgtttctctgtcacttgacatactcccctctttggggtgttggaggaaaaaatctctgtgccaacagcagagacatggaactagtgtgtcacatccactctatgaacagaattcttactactatttataccctaaaaagcaggccattttctagagtttcaccccctcaccagaaagaatttatttgtgagtattggttgacttactataacaagagactcaagtgttaatcattaaaggaacctgttagtgctttcttagaagtaagaggaagatcacatttaactggagagtgccttattgtggttttcaaggaaggtcaaagctcttacttatcactgctcaatcttcacccgatgcccaaagaattaacataattttgaaccttaccctggagaagcgaaatgggaccttgtcctccagaaatgcagaagacactgtgctgtgggctgggggagtcacggagcacgagagtatccatctccagccctcactggaaataaaatctgcacagttctatctctttccagggcagccaccttgttctctgcatgaggagcatggaggtccagatgcttccaggagggatctggggcaaagctctaactaagcaacacattattttgattttgtgtgtctgggatataaggatggccggtaaggggaacaataaagttcttgagatttcacaagtaatttattgatgtccagaatttgaggtgctgatggtacacctaagtggcaatatgcaccaggcagatcaatatgtgactcgtcagagaaagcagaatgggtgatgtgatgtgcaatgccacagaagcactgcagccaggagaggtgacagctaatggggatgtttggagtctttgagtgaaccaaacacatcccagagtaattgtaatttatttcagtcaatcttctgtacagacttagcattcacctttggaggaaggtcctttgagcagggacagagatggtgatgtcactgacagtcccccttttactctgggtgagaggtctagaatcctcagctcctgtattcgtgcccacaagggcctcatctaggtgaaggctccacctgccccaccctgccatggccaccaggctcctctgctgtgtggttctttgtctcctgggagaaggtgagtccccacaaataaagcacctgcatttttggatattgccagttatgattccaattatgtttcttattctgtccccaaattctatctcttttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtttggtcacagcgctgcagaatcacctgctccctgtgcagaaaccctggtgcttcctcttctcctccagtacccagcagctctcagcagcctttcttgctcctcccctagcacaggaagtacataggtttcgtgttccacatgtcctaggcaaggcaagaacaggtcataaggacacatcacgttaggaaacttttggtaggaagtcagtgggtgtgatggttcctgggattccacacatacttctcacaagggtgcctgagtccaagtttgagggcgagtgtcacagactggagctttcaagtgattgagtgagcttaaaactgtgcagccattgcacatggatgcttatctcctttgctgctttccgttatggcttctttgccatttcttttctcttctaccttaaaactttcaacatctttgatgacttccaacatcaatattggcttcccagttttttcacttgctcacttcaaatgatcatttccttcaccttgtgtcagatattcatttccactttctttttctagattccaatgacaaattatttgaattacccccaaatagtttcctcaagcatcccattgtctcatgcgggcttctcttttcatctctggtactacttctgcagcaattcttcaacccatcaggaccactaattgacttctcctgcaaatattgcaccatatatcatctcctcatgtactatattccttatctgacttagactatgtgttccaaggtgattgtgaaattttgcctatgtcttcagctcttttctttttctgtttcttacctggaaaataaaatggggcctactctgtgcccctttcaatgacacagagaacataaaatgtcccttacccttgtcaagcagtattataacgatacagtgtgtcttgaggtctgtaagtccctctatgcatataaaattatatacttttcttctattaaaataatttgttaccttttaatgagttcatcagtttcatctttcaattatagttatacttttgacaattatagaagtactaaaaaaagttatgcacccagaatgtatgattctatcacttttatgtgtgtgcgcacttcacttcatacgtacaaaaaagttaaaagaatgccgaataggcatatttatccattctcttgtaggaatgataaagatgaacttccaaggggaaaatattttcaaaataatccatggcacataaaattatttaagaaaaaataaatcaataaatatccctgttaagtttatatatagttttatatgcttgggtaaggaagaaaaaaagttgtgatatattttgctggttatttggagagataaaatatagaaagagcagaaagaacatgattagctttgtctttgtttaaaatttttgctttttaaatttgatacactatttaccatcaaaatttaaaacaacaccactgctataaaacaatatacagacaaactaaaaagaaaaaggaatttactatgtaaaaaaaaaaaaaaaagcgagagcttataggcagagtattaaggggaatttaaaattataaagacctgtaagttttcagagaggtataggcctcacagctggagctgggattttaatgtccatatgaaagagatgacagaaaacagccagaattacattgcttgccttaatcctggagcttcaaaatgctcccaggctttataaagtaaaagtattacaccccaaagacccagaaacataattggaaactggatgtttggtcaggcctttgggtgatagataaaaaggaaaagttaggagagaaaaattgaatcttcagactgtgtctcacatgtgtttggaatgaaatatactctgcatggaatgtacaccatatacccaaaaactgacaaaaaggtccataaccattaaaacccttggagaccctggcattaagagattcaatacggttctggagtaaacttctgcttccaaccaagatagattaacgggaattagatttaacttcttgcttgaaacagctaacaccccaacccccaccctgtccccctgcacacacacattcacacaacatgtggaataacggttgtcaagacattggaagtaggcaacagaagacagtgatctctgagagatggaaacaaccaagctgagaactatgactgtcttaatacctggagggagtttccaggccctgggccagaaagaggaatccaagcagagctgggtgatctcactgagctgagtcagagttggaaatacaagatcaaagcagctagatttcacatgacaggccattgaaaaggcgattgctgcacagagagaatcctggagaccttcctagggtctcccttaacccttcagctgtgctgtaagcagtacatgtgtgaggaaactccctaaggttggagaaagagccactcagcaagattagaggaaacaatgcctggagctcacaaagggctgagagtaatatatacatatattactctcatatatatatgtatatgtatatttttgcattgagaatgggaaacttaataattcatgggtcaatcagtagaggtttcagatgacttatgcctcagtataaaagcaaaataagcccttcactaaataagccacatttggctcctggcctatgtgggtgagacttcaaaatatcaaactgtttccgagtaacttaagtctcagagcaaaactaaagaatatttctaatgtacaagaatacctgttcggagatatcagtatgaatttattgtttttaaacgtatagatacaatggtaaagaaatgaatacatacctgtgtgaataatgggttggtatatatacatgtatttcatacttctgtccacttagaagaccactagtgcacagatgtttgttgccaaatattattctccaattaaaaaaaaatgaaaggtggttctaggaccctgaggtaaaaaatacaagaatgttgtaatgaggttttccaaaaaaaaaaaaaaaaaaaaaggatgggacatatctcaaaaggacagaggaatcaatctgaaagagcttccccaatgactaaggctggaacaatttgtaaaagaaaattcacaagttcacactgagaatgaaacgattaaataaataaataaataataaaaaatgtgagaaaggacaatctcttactgaagaattccaaattgcatatgtagaagaaacagagggaaatagaaaagtcactgtgacaacaccactgtgagtaactgccacacataaaacccaatagtgagtgctaaaattagtgggtgtagctaattttaattactaattaataactaataactttaataactaattaagaagaaatggatcatttgtacagtcacaaagtgtcatccccaaaatattaattaatatggtggttttaacatatgcccacacattcttttatactcatccctctagattcccctctcctggattcagtggcctgcctctaatgaacagacatgggaaatagaaaaatggtaaccgagtgatccaaagtaaataaactgacccataataagtcttgttaacctcatgtgcattctcttatgatgcaatgttgtgatgttatcatgtgactacatatctgtaatattcctcccccaaatctataattcctgtctaataatgagaaagcatcaaacaaatcccaaactgaaagagattctacaaaacacctgaccagtaatcttcaaatgtcaatatcgttaaaaacaaggaaagagctgtcacaaattgaaggacactaagaagatatgacacttaaatgcagtatgggatcctggattaggtgctagggcaggaaaaggtcattattagaaaaactggggaaatctgagtacagtctagcttagttgtgccaatgtcaaattcttagtttgtgtgatgttagcactagtgggtgttggatgaaggatataaagtcacttggtagtattgttatagctacaggacatcaattctccagctttgggtcacctgagtccctatcaagccaatttgtgaagctgctgttagttgtccttactccccagtcttggagctctcagttagacctagaatcaacctcttcttcctcttgacctctgcttcactgcatcctaaacgtggtgaggtggaggggtggtgagggaggctgagcagaagcccatcattcagaagcccatcactagagcttctctgatgattctctgagacaggggctccctctgtagtctcctttgtgcacaatcccaagcacgctgggccacacagactccaccaaagctagttttgtgaggaggcaaatattgaggctccattgtgaagagaatgtccatgtcagatttaagtacaaaagattaaagttgatgcattactattgcaggaaaatgatacctgtgagaatttccaaaagccagattttgtattgtgtggctggctgagtaatacccctccccacaaagacattcacatcctaatccctgggatctgcctctgttaccttagatggtgagagtagactttacagatgtgatgaagttaaggatctggagataaggagattattttggattagtctggtggccctcaatgcaattacatgtgtccttataagagatagccagggggagatcagacacaaatggagaagagaaggcaatgtgaccacaggagaagagattagagtgaggtgaccacaagccaaggagtgaggcagccactagaaacagaggcaaggaacgaatcctctcctatagcctccagggggaatacggtcctgatgacacctggattttggtccattgatactgattttggacttttccagaactgtgagaataaatctctgtcattgtaaaccagcaactttgtggtaatttttatagcagccactcaaaattaacacactccaatatgtccagttaacctgagactaggccaagaaactcatgttcttataatattttctgcaaaccttgctgtcatgtttttatctgacacccatctcaaactataatgaaagaaaataattttgagacttcaatgtccccctgtctggggtgtgccttccatagttcattggaaaagtctagtctcctttcaagattttattccagcagtacctcctcttgaaagaattttaggcattgttttctgttctcagtgcacatactaaaaagaaaaagacaaagactcatgtctacttgatgtttacatttttgcggggagggagagacagagataaacaaataagtaaggcatatagtgtattagcaggtgatacctgcaatgcagaaaaagaaaaggcagactaaggtgagggagaccaggactgtcagagtaaggagcgttgaaatgacaatacattgttcagagtagggcccaatgaggaagtgacctttgagcaatgatttcaaggagatgaaggaaagagacatgtaggtatctgggggaaaagaattccaggcagagggaggagccagtacaaataccctaaaaaaatattttaggaccaatgaggaggcccatatgactgaaaaattaaggaagggagtggtagactttatttccaagcggtaatggggcaggatggatcatttaagaccttgatggccttaagtgctttgttgttttgttttcttattccaaataaaactgggagctagtagatgatttggagatgagtgacatgatctagcatgttctagagggctgagtttgagagctagttcagaagtaggtgaaagcagggagatcagttaggaatctattgcagtaatccaggaaaaagatgatggtggccttgtcctgagggttagcaaagaaggtgatgaaaaaatggatggattctgagtgtattttcatgatagagccagttgaatttcctaatggattggctatagggtgggatagaaaaagaggatttgggaaccactctaaggttttcagctggaaggctgttggtggagtaaagttgaggataatctttcatgtttagagcatgctgtttgagagtggtggggggaaaatgttgattggagtgcattagagagataatgggaaaagagaatttggaggtaagtattgatcattagcaatagcaacaatagctaccgtagattaaaatgccccacagtctatggggatgtgatacatgagggaagacagggccagatgggatgaggtaggatccagacatcagactcaggagctacgagtggtatatataaggttaacacctagtcaaatgcataaacaggttgattttaattgatgtcagtttttctccattgccccctctagaggcaatcttcttcagagaaccctggctaggtcttctatgtttcatgtccgtagagggagctcctgagactgtggacattggctaatatgctgatgtcactggaggccacatcttacagggccaagagacagatttgctttcctttttctcatacttgtaagctccttcatctggaaatgtgatttacctgggtcctgccatggtttccaggcttctcagtttagtgtccctttgtctcctgggagcaagtgagtcttcaggtacttaaatatctgtgctgtaccctatcccagtctattcatgtcatgtattctgtttttgtctcttcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagccaagacacagtgcttcacagtcgtgcccttgctgtgcaaaaccatagccttctcctctcaactcacagctgcccaaaaggaaggctttccctgtgccttctcccccaaggaggggagataaagaaccagaattaactcatgaaatacaagagtattccaagaagatttgggtgaaaatacttgtggtttgggggatctctgaagttttttaaacagaactcaaactatgtgtttctcatatttatttttattttttaaagtgtatgttgcctggttataaagcagacttcttgcctatcttgctgctctgaaaggtttgtgactctgactgtgaggccacatctttatatcccttcttatagtaagagaaacaagtctttctgatgaaaataaaaatagtgaataaaaatgcatttactactggcttttaggatgctcaatgatgatgctagcaatggtggtagtggtgacgttggtaatggtggtgatgagtttaggttgcttttgtctagcatttataaatttccaaccactttaaaacaatctcattttagagtggaatagctaagtccattatcagaggttaatgctaattttctgttcacatagggtctgagtttttaatgtaaaaaatatagttagcactataaatagatatctgtcagccgatacagaacattttttaagatcacttccagttgctgcaataggaatatgtattcctattttttttcttttttctttttctttttttgagacgaagtcttgctctgtcgcccaggctggagtgcagtggcaaaatctcagctcactgcaacttctgcctcctgggtttaagcgattctcctgcctcagcctaccaagtagctgggattacaggtgcctgccaccatgcctggctatttgttgtatttttagtagagacgggatttcaccatgttggccaggctggtcttgaactcctgacctcaagtgatctgcctgcctcagcctcccaaagtgctgggtttacaggtgtgagctactgtgcccggcctttttttctttttgagacagggtttcattctgtcaccccggctggagtgccatggcagtgtgatcacggctcactacagcctcgacttcctgggctcaagcagtcctcctgcctcaggctccctagtagatgggactataggtgtgcatgaccacacccagctaatttttgcattttttgtagggacaggtctcactatgttgcccaggctggtcctaaacttcttggctcaagtgatcttcctgccttggcctcccaaaatgctgggattataggcataagacaccatgcctggcctggaatatgtaatttttaatgagacctaatggtataatacattctacctggttcaactgccttcttttaatatctggattccaatattctgctcatgtttcagccatgtttttgcaaacagtcctgaaattcactctaataataagtttcattttcccagtctgattgttatttagcacctcaaattattattgaactcatcctaatcctgattaggcaaatggatagtgagaaaatattacaagtgggcttggattttaattttttcaaacaatttaaaacccattttccttttctaatgatcaagatccaatttttagataatcagtactctctctttctatgtggacatgtaatatgaataggtatattgtttctgtcacaggcatcgcaaactcatatcttgcttgaaacttgtcgatgaactcctttagtatgacaagaacaaagagaaatagatttttaaagcatagccacatattggacatgagtttttcttcaaaatttcagctgcagaaccctaactggtgcctttccttttattgtgttatgtaatctaaggtcataataagtaactaaattattgatttatttttccactctgtaatctctccattatatttaaaaatagcagctatgaagcaaaacaagttcctcgttgggtacattgcctcaactccaaaatctaacaagcagaagtttaattcagtgctttgccatttcatactatagacaccgaatgtcctatcctataaggggcacacagtggttctctttatagttctgttagctcaagtggtatctttaggtacaatttttagaatttttttatttgttaatctttcttaaggtatgattgacagaaaaaaattgtaggtatttaaggtatacaaggcgatgttttgatatacatatacattgcaaaatgattaccacactcaagttaattaacatatccatcacctcacaaagttacctttgtatgtatatgtatggtgagaatgatctactctcagaaaatttcgagtgtacaataatcattaactatagtcaccatgctgtccattaggtctccagaactttcgagcacactccaaaacatcaacttttattctgattaagcctcaaatatgtcttcttgttgcaaatattagctatttttagattagctataaataatgaaaaatgctagcataaaagatggaaagaataaatgcagataagggctctaaggtctttacactttccaggaagtgataaaagctgcaatttaaattatacatgaagaagtcaaggatggcaactcctataaacagctgatacttcaaacctggaatgtctagtgctaagcagcccggacccctgcacccagcacacctctctttggcatgataggaggatgagggatccaggtcttctcctcccatgctgcccttggcctttatgttttgcctttcattagtaaggcttctcccttaattatcaccctatgacaggaaattcatcctaagcctggacacgtgagagatggtaactctgaagcagccccctgcggatgacaccaaatgaggccacacccagaacaaattgcaagaaataacaaggtatttcttacagaatccctaagagaacatgtctgtctgcatttaagtgtctacagtcataaatgcacagcatatgattggatcagatggaactgaaagactttcagtgcttcatggtgcccataactctcattgtcctgaagtggtgttggcagtggactcagcagggtgccgtgagatggtgaggctacacacatacgatcgtgaccaagctggctacacagatgggccaaactcaccctgtgatggtagacagagcttaccaatgggttccatgaatggacaatgggcatgctgctgtaataatcccttcgaccatgatggaagtcaggcaagacccaggccatgggaacattgaaaacagtcacctctagcctcaagtatttcctactgtttgccacactgtgcctacaaatatcatttatgatacagcttaaaattttcatgtttgtgaaaattattatcagccttatccaatctgatattttgaatgaaatcacattaaaaccatatattaatttaagaactggcatcttcataatagtgagtcttctacagtttcctagaccactaaaaaatcatggattgctatctcagacttgaaatgggtgatccttattcttctctcagtcagaacagtgaaaggtacagattcatggcagctagtccagcttctaaaagtcaacttctaattgtctactttaggacaaaaaagaaataatatccttaggaaggccaccatggaattcattctatctgaacaatccttacataatatcatttcttataatatgtcctcaacatcgtgctctgcatatatttctccaccatctctaaaaatcctcttagcccaggcctcctcaaactttaatgtgcatgtaaattatgaccttgttaaaatgcagattctaatccaatcagtcagggttggagctaaggttccctgtattttgaacaagagtccgtccaagtgatgccaaagctgccagtccatggaccacaatgagcagccaagctctagatgacacctacaataattacaggtgtaaggcccctcttctcaagtatcattttgcacagttcctggactaggtcagatacagaccctacttaccacatgtatctctgtattccaagtattacgtaatcatcagttttcctaaatctaggcaccaatattttaacatatattttcatggtataaatagaaattaattttctatagtaaatacactaatacctaatcacattcatgcatctttaatgtgagtagcaaaaagccaaggcactatcttaatggttattgagtgagactttagcaaatactatctttatggagaaacctctgggctgctttttaggatgtgagaaaagtgaggtaaagtgaggagaactggatgaacacgggacagagacagggacaggggcaaatatggggacacctgtctcaaggaagcagcaaatgatatagaaaataaatatctgttccatccctgttccagacaagcccatgtacctgccaagtaggaagctgtgtatcacattgcaacaaggaatgaccccggccctggtaaagtcaacagcaacagtcatcacaggccaatctgcctatcagggactggagactctctaaactcccacctctcaacccaggaatcagagcctgagacagacagatgcttcattcctgtatggggtggtattcctgccatgggtcctgggcttctccactggatggccctttgtctccttggaacaggtgagtactgggcagaaaggaaatctttgagcaaagctatcttgtcctcagtctgcacctttcattcacagcagtaacactgttctccttaactctgactccaaatttgtcttctttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagcagagacacagagctgcagtgcttcctgctctctgttcataaacctcattgtttcccagatccaggtgctttctctaggacttctccctcaccacctcttacaacaataggaagtgggttggtggctgtcaatatctgtagacagaagttgagcacaaaccaataaaaaccattgacagttatgccaagagtggaaaagtggttacacatgcctggcattcagttggtggtattttcccaggatcacatttagaacccatgctgtccttttcagaagacaaataagaactttttctttctttttttcattgttttaatctaagtcagaggcttagaaatataagaggtgatatgtgaagaattatggacacccaatgtctatgaagtccagtctctggcattcgatgaactcttataggatttaatcctcctggagaatccacatgtttttagcctagacctggagcaactacctcattaatgggagaatgaaagcacaagtatcccaagataaaaatttctcagaggtaaaaccacattggagagaaaaaaagagaagaccatacattaatctgctcatatctggagttggaggtactattgagatgagcaaatggaaaccataaatacataaagaaatgatattgaaaatagagtacatttggagatgaagatcatggagccatctgtatagaagagagtaataatgtcattaaggtgcataagagtgccagcaaatgtcaataagaaaaactacaggagggaagaagatgggagatcctgctccccttaacaaagataaataaaatgctgagtgagaaatattgcaacctcataaattgtcacatggaagtatgtatttataaattaccattataattaacatccctcaatgagaacgatattctgagaaaaaaaagcagaaaatatagttatatggctatctaaaaatgtaaaattttgcacattaaattaagataatctaggaaaaatatgacaagacctattacaaaagagcttttacaaattgtttgctttaatgatattaataacataatgatagctaacatttactaagcacatattacatgctagaccttaagtcttcttcacatatatttatagttcatgttagttttataacaacctcagaaagttaatactatagtaacctcactcatttatccatgaggaaactgaggcacagacaagtaactagccctttatcacgtatctcgtttgtggtggagccagtatcaaaatgtagacaatttactgctggagctcattctgtcttcggagtttacatggattctaagtcagaccttcagataggaaggtaaatggttataagccagaagatttccacactctcaccaacattgcactggcttttctttgggtcttggccagagggtgagcccttgtgactatgcttcactggttgactaggtttgagttgcaccgaggaccaacatagagaaagaaggtctttgggataaacctgggaggatgaagggtaaaaaatgcagaacttaaatcttgatcccaagggatcatttaaagatgaatgagtctcccttagaggatgagaaattaaacataaactctttaacttgcagagatgctgaagtgttttcctcaagtagtaaactttgaatcatggttatatgcatgggagggagcctatggggatggaacatggatgaaaaagtgacaggatgttcagggggcaggtgcgggcagaaaatcagctgcctccaagagtggtgagagaagctgtagagcatcctttatccagactggcacaacatgcagtccagaaggctgtgagatacgaggaaagggtcaccataaactgcaacctgactatgtcaaaaatgacacttggaatccgagagtgggtacgtgtggtggtatcacagatatacacccaccccatccccgcccaactgggagataagagacttacaggtttagcactttcaccactgggactagaaccctggatttagctagaggctggcttagaccttttcatggttcttctgtatgaaccacacaatttagaaccatactatttagagatgatcaatttatacgacctgcataaagcctgtctttccagaagaagctcaggttcaaaaaaaaaattgattcctctcttgtccttctcaatcttccctccttccttctttcctttcttcctgcctgcctgccttcctcattaaggatagacatgaactagtcacctgtatactctctgaggtatgctgttagtgctgacaacacattagttcaacctagaaaaactaaccctgttttattttatcttatctgagagtctgagacccctctttgatccttaaaaacttgccaatttcttgccaagcaaatatgtgcagggttttagagagccgtaggtaacagagacaaaatagaaacaacacacagaatttggagcaaagcctttagatctctaaagcttgaggccccactgctgctctaagcctgcctatggcaccaggttcctctgctatgagtccctctgcctcctgagggcagtgagtcctgggcgtagatagtctgtctgccttgggcactcacactgtagtctgtttccacaccttcctctggtagtccaatattcacccccattttcctctctagcccctgctcctacactctagtccacagactctgtggatatcctaatcacagagacagaaacagaggtgacactcagatgtgagtgatgaaacttacaatgctgtaaacaagactcaggacttagactgcctactgatgttcattcttgtgccatttgttcagcaaatatgtatttaggaactcctgtataacagaccttgtttccggttctggaaataaggtaataaacaaaccagagagacttgttttaaactcctggaatttataaaccaaagagatgtatgtgatgagaacagtacgactctggataagaaggaacctgttaccttaacactggccagtgcaaacccagtctggcagacatctgtgatcctctagacttgtaaggaatcctatagctgtatagctctttgcatttaagggcaaaactagacaagacagaacctcactctcatgaatccatgccctaagaaagagaagaaacttccctcataggaacattggtgcagtctcgcagttttcttatcaagtaggaaaattagaactgctaaaactttgtgccagaatttaagacaaataaattgcctggatcatgcattatttacaattatatttacaattatatacagatattttccctaatataaatctgttgatgaaccacttatgtggcatataaataggacttattaaaagttagatgcggtgctttagaagatatattaaaattattagagtctgacttaaatttttaatagtaatacaaaatataaagtaccacagccttgttcagaagaaacaggatttctgaaatccaccagaatagctttctaaaagccagtatcttatggcctttagtgggctgaaatacttataatgatggattggaaaaatggatgtttgagtgcataaggttcacgagtataagaaacaattggtacctcctaactatagattgtcagtttcagaggatgagaatgaatgtgccctcatcctcattttaattttgaaagacaatgcagatatccctactatagaatcattttttacatcaccacctatagagattaacaacatagatgtttccagctccctaagaggccaagaagtattaacccaaggtcagattcaggtaattgatcgtgactcacgaattttcagagatccacaatggttgtttttaaattttcagcagttatgtctttttctctggggagagggtattcaaagctcctcatgaggccattctggactacttttcccctcctgccccctgcccataaaacagtttacagaaataggtgtccagaccgtgggctgtagttcaccaactcctgctctagcctaattttgtctcattactagagcatggccattctgtggatgccagtgaagcctttctggggtttctctccaatgccttttaaagctttttcctacacagacacagtttactgtttagccaaaaaattaagataattcctccagacatctggagttcttgtgcagcttcctcctctctggtggtctttccttaaaaattctagctgcctcagcccccgctgattttgtaacctgtttccgcaactcaaaatttgccatgctctgttgctctcttccccattgtgtatgtgcagaaattgcccccatgttttggtgttttggcagaatcccagtcctgtgctgtctgctttccagtggctgaatacaattgtttcacatattctcttaatttgtgttacttgtatagagcaggatgctaaaggcaattggattctacaaagtgatcacgtcacagagaagccgccgacagaggtggagagagccacacagatagccagctgcctgtgctgcctgctcttcccctaattctgccatgagcccaatattcacctgcatcacaatcctttgtctgctggctgcaggtaagtccctgttctgcagttgtcagctccctgctctaagcctttcatccatgtcatcgaactccctcatgggctcagtctccaactcctgtctgctttctttacaggttctcctggtgaagaagtcgcccagactccaaaacatcttgtcagaggggaaggacagaaagcaaaattatattgtgccccaataaaaggacacagttaggttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagccaatccacaatgttaaatattagctaatcttaggacacagactcatcacggactcagctcaggaagcaggtggtatactaggttggaaggaaataacagaaactagagctagcttaagccaaaggggaatgtattataaggctaaatgtatgtcccatagaaccacaaagcaagaacacaggaacttcccagaaataaactgcaatgaaaccttagaaccggtggtcgcgcctgtaatcccagagctttgggaggccgaggcgggaggatcacaaagtcaggagatcaagaccatcctgactaacacggtgaaaccctgtctctactaaaaaaaaaaaaaaaaaaatagccgggcctagtggtgggcgcctgtagtcccagctactcgctactcgggaggctgaggcaggagaatggcgtgaaccgggaggcggagcttgcagtgagccgagatcgtgccactgcactccagcctggacgacagaacgagactccatctcaaaaaaacaaaaaacaaaaaaaaaccttagaaccatggcatggctgattgacaactcattttttatataccttgtcggcctcattattctcttttattataagttgtcttttctgtttcttaggtcttacagtgattagaaaattgcagatttaggtgttagccctccagtcaattgagaccaacgtgactttctctcatgctagattacaaatccagggtgcagggggaaaaaatgtgatcctgctttactcaagaatgggctcgtggaaatccaagggaattgaattattttgaacaagatagtatctgggagtctgtccctctgaccttgtggaccaaggatttcaaggggtggaatccagtcagaacatccaataggcacccatcacaagtgagaagttggggataatacattttctggaatatagagaccttgggaaaagagaagagtttggagaggggatcaaaaccttattatttagaacaatatcagaccacgtaaagagtctggttaatctctctttaagaaattaaaccggccaggtgtggtggctcacggctataatcccagcactttggaaggccaaaagcaagcagatcacctgaggttgggagttcaagatcagcctgaccaacatgaagaaaccccatccctactaaaaatacaaaattagccaggtgtggtggcacatgcctgtaatcccagctacttaggaggctgaggctgaagaattgcttgaacctgggagggggaggttgtggtgagccgagagcgcaccactgcactctagcctgggcaacaagagcgaaactctgtctcaaaacaataaataaataaataaaatagaaggaataaaaagaaattaaacctagataacacaaaaagcatgttcattttaagtgtgacaacttcagatcctacaaattcactaattggcctctatggcactgaaggagaacagattaatgtactcttggtgtaaaacatattaatgcacagagaattaaaagatcttcaggtatatgattcaaattgtaatgaggggcaatgtactcaacatcaatattcctaatgaggcattatggtatcaactgtacctaggcaggagactacacttatgttgagcagttatagaattcaaaataactctgttaaaatttgataatccattctgttcacagatctggtcaccacctagcattcgctttgagagaagttcctttattctctccagttacatctgctcttatttcagtataagttgaacccagttgtcttacttccagaagtccaaagttacttcttttcttgggaaaaaaatttactgtgactcctggaaacagaagttctcactttatcatttttctgatctatttaatattataccttctcattttaagttccttttcccgctctccagaagtgagtgttccttagcgttctgttctcggtccccctcaagcccagtcttgctgttggtggtctacatctttgcttttgtcacagggaagtcactcctctagatgctatcttcagctttttcttgaaatatttccattctaccaaaactgttctcctaaagattaaaattacgtatttcccagaccaaaagacgcatgtgtgtttctttgcctgcttgatctctttgaagctcttgacaatactgaccatgccctaagtcctgagcattaatttttgctcagtttcatttacatcattttcaactagtttctcattttctctctattctttttgttttcaatgcagctcccagaaactaaatctatccatttaatattctttttcccaggaaaattcttctcattctatttaaagtgtaatattctagtttaatgggaaagttttttgttgttgttgtttagccttttaaaaatctctactgaaaaaattttggatatgaaaattagccaggcatggtggcgggagcctgtaatcccagctactcaggaggctgaggcaggagaatcgcttgaaacttggaggcggaggttgcagtgagctgagactgcaccactgtgctccagcctgggcaatggagagagactccatctcaaaaaaaaaaaaaaaaagaaaagaaaagaaaaaattgtgaaatgtggtctgagacaacttttctcagtgtcacctgaggcatgggttaaacaggtatattctaggacaggttcagaatttcagagtcgaaatttcttgttggtggactttaggaatacgtatcattgctcctgagtatttctgttagtgctgaagttctgccccaaggacttcataagattaataacatcgcaaatcttctgtagtgctttaaaattttgttcttcatttttttattctcactttcttctctttccttttccacttcctcttatgttttccttaatcttcaactttcctaagcacctgcaagtgggattggagccttgtttaacatcgtccatgtagcaaaataaggatgaggccaaatatttgaaccaaggatccccatctcctatggaaggtgccctgaggttgtgggtgttgctggggacatgatgtcatggccagatcctacatcatgcggccaagggaacccagaactttcactgctctttgctactgcacatcagaacccatcgctgggagtgtcttgcactgcctgacctcaccatggatatctggctcctctgctgggtgaccctgtgtctcttggcggcaggtgggtccaggtatacttaaacatttgcataaagatgtttttggctgggcgtggtggctcacagccgtaatcccacctttttgggaggttgaggtgagtagatcaccagaggtcaagagttcgagaccagcctggtcaacgtggtgaaaccccttctctaccaaaaaatacaaaaattagccaggcgtggtagtgtgctcctgtagtcccagctacttgggaggctgaggtgggaggatcacttgaatctgggaggtagaggctgcagtgagcagagatcacgacatttcactccagcctgggcaacacagagagaccctatctcaaaaaaaaaaaagatgttttctttgggcttcccttcaccttctatggcttccgtcttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagcggtggcacagcatggctgagtcagttccctccagggtgcaaaccctctggctgctcttctcccagttgaactccaagaaaacatttgaaaaagcctcttccttatcttcctaccccagaagaaagaagcgagttgattgttgtggctgcagctgctaccgggagagtacaagaccatgaattaaggtcttaaatggtcatgatgggcacactggacaatgggctcctgaaactacccaaatacaaaatgagacattctgtggatcaggaggaatccacatgtttagaaggaagggccccagaccaatttccaagttcagagaccagctatctgaggttgatattacttaccaaaacacaaaaacattcctactgattttatctcaaacacagttctcctgcaaactcttcccccaccaacgtaccccagcagaggcaatgacatgtacatttatggaacagcctgttgactactgcagatccatctcttcaataagaccaactttccctggaggtcagtgactaaaccaaaccgcaaggcagacggcaacacgaccctcttaggggatggatgccagagaaacactgactaaaatccccactcggggactgtcctagcacattcagttcctcacacagctgcacaggggagcgcgacgttttattctgttacttcaaacactcatctgttcctctctctctcttgcaggccctagactcacagacactggaattagagtcagaaaaattgctttctaatcccaaaactggttttgtttactccccttcagctgtgaaatcttggcaaatgctcttacttctctgggactcagtgtcctcctcttcaaaattagagacttgctccacttagtctctaagatctgatacaaatatgattatttgacttgctatttatttatttatacaaatattagaatatttatgtatacatttaacataaatatatttatatttaataaaaacataaaatttataacattttatataaatttatatcaataatatatatttattgatatacttatatcacataagagatatataaatatatgcaaatatattttatgtaaattttaatacaaatataaaaaatacattttctatataagtatatataaatacttatatataaatgtattttatacatttatatataaatatatatataaatatatatttatatataaatacaaatacttatatatatttatatataagtattaatatataaatatatgtgtttatatattattatatataaataatatataaatatatgtgtttatatattattatatataaataatatataaatatatgtatttataatatttatctatttatctatctacagctattttacacatgtgacaatcagggttgcgatggaagacatcactacaagctggaaaatatgaacataattacatatgcagataacacagatccagagactatctgattgcaaggaacattatagatcacccctatataccataactttgaagctaatttgaaatgtggtttgtgaaagtattatacatttcctgcaatcccctccactgctgctagatggcagtaaaggaacgtgttagaaagtctggggaggggacctcatgatttatttaccgcgcagtcatgatttaccacgcaatcacggtttagtcttgttgtcctgtcataattaatagtatcctctttcacatacaaaagtgtctcaatttgaacattaaactatacggtcattgtagataatgacacaaatgatagcatctctgttgaaagtaaattgtttattaatgttgcagtaccttcatttctttgtttcggtttaatgaaatagattttttaaattatagaataaataaactcgaagctatagcattggtctgctttttgtcattttactatttaaatatatctcagccctacttacagtttgtattagcgatatgtggtgtatgaagcctcaacttaaaaactcagcttggtcttcgtagtgcttctgtcactgtctgcccagcacccactgcctctcaatgtgttccaacgtttcccaattcctacctgctaataaacctaccaggatatttccagacctattttctctgtgaagaaaaccaagcgacattgactttccctcattcatctactaatacataaatgtcaccacatgccagtgacaacggggtaaaataagtaataaaagtgaaataggataaaagaattgttatacatttattggctccggagaaatccaccctcttctctctagtctcctgcgcaccctgccaacaatgtcattggctgtaaaaatacctcatgttcatttaacactctacagtttactgagtaatttgttgtttcattttcatgctttaattatatgtttccaggttctctgagcttttgagctcctgctcttcccagatgggctttcataacaaggccagcccctttctctctccccttccgccagtgcccatcatttgaaccaaattttcttcctgtctctcttacttgattctttcccaacctgtgccttctgtttggtctcttaaaatatttccctattcagtgataactcccttaatgaaggcatctttattgactgccttggaaatcctcagaattatagaaacatctttcatgtccaccttggcatgttttatatgtttcacatatattttcataaataataaaaaagttatatattttccatacgtaataaaaatgtcccttcaacatgcgtaatatataacaagattagtgatcttccacctaatgtcttggacaatgtgacttctgtctgataggtatagtctttgacccctacttactcatgattaaagaaatacctttctctcaaaggaactatctgtgttcacagcgttaagtctcatcctggatgctgcaagaagacgttcaaatgtccactgcccacccaggtatgtgatgctgcctgccatgggtcactagaaggtgatagttaaaagtgtaggctctggaatcaaacaatgcagaccacaattctggctcctctgctcaaatgctatgtgaacgtgagcaagactgtgaacctctctatgcctcacttcctcacctctaaaatgaagataatagtacctacctgaggctgagcacagtggctcatgcctgtaaatcccagcattttgggaggccgaggtgggtggatcattccaggttgggagttcgagaccagcctgaccaacatggagaaaccctgtctcgactaaaaatacaaaattagctgggcgtggtggcacatacctgtaatcccagctactcaggaggctaagacaggagaatctcttgaactcgggaagcggaggttgtggtgagccaagattgcaccattacactccatcctggatgacaagagtgaaactctgtctcaataataataataataataataataataataataatacctacctgatagtattgggttaaataagataattcatgaaaatccctagtgtggtgcctaaaactcaaacgctaatatacataggtttggcctaatattatgaggtgttattatttaggattgctgtgcttcagctttttgttgagtttcacggtttggctcttactggaccactgacagaagcaactccatgactggttattctgtcattacccccagatactgtgcgataccttccaaatctactacaaacaacgagtgtgcatttctcttgcttgttccatccaagaggaaagagatctgtccagagatgtcattctgcttcagtcaacccagccgtgccagacaatatcagcataaatgtcaaaattaccatatgtggtcaacatatgctgatactgtgaccatatgctacatgggacttgttcccttaattgtgaataagagaactattcgtgtaggtgttattatccccaattttataggctcagaaagagtaataattggtccaatgtctcacaactgtatgtttcatggcaaagattggaaatgaagcaataacttttttctagtaaaattacaagaatgaccttaatttctttctaagcaaacgtagcgtatcatcacaacagttatgttaaatcagctcaataatctcctagaagaacatattataatattcattagaggtggtatgggctttaagagggagaaaaaactaggcaggatattgctatatgtgaagtaccatgctagatatttcacatatggtatttcatttcatccataccagcaacccaaaattatgttatttatccctgttttactaacaaagaaattgaagtttaaggagggtaagtgcaggatgaacactaagccaattgtagagctggcttttgtaatcagggattttatttaattcgatttgctctactatcatcatgttgaattaagaatggcaaagggctgggtgcactggctgacacctatagttctagctactcgggaaactgaggcaggagggttgcttgatcccaggagttcgaggctgcagtgagatatggtcatgccaccgaactccagcctgggtaacagaatgagaccctgtctctaaaaatttaaaaaaaaaataagaaattttcaaaaaagaataaaaattaaaatatatatatattttaaggctgggtgcggtggctcacgcctgtaatcccagcactttgggaggctgaggcgggcggatcacgaggcgggaaatcaagaccatcctggctaacatggtgaaaccccatctctactgaaaaatacaaaaaattagtcgggcgtagcggcgggcgccggtagtcccagctactcgggaggctgaggcaggagaatggcattaacccaggaggcggagcttgcagtgagctgaggatcatgctactgcactccagcctgggcgacagagtgagactccctctcaaaaacaacaacaacaacaacaacaacaaaaatttaaaaaaatgtgtgtgtgtgtgtgtgtgtgtgtgtatacatatatatactttttttttttttttaaagaatgagaaaggaactagaacaagcagagagaaaaagcccaggggcacgacagctaaaggatgactaatggaagttgaaaataggaagctgaaaggtacagaaatactgcgggaagacaaactacaaattatgtggagaaagacaagaataagaacagttcccagaggtctgaacacagcacattatgtcttcttgctatacagtggccaccaaacttgtcaatactgtaggcaaatgctagtgtcattgcttgtggctaagcagaaattttgacacttgggaaggttggcatgagattgaacagttgccatggtgacctgccatagatattttgattgatgatgagtagacacaaagtgccaatgcttaagacctagcttcagatacttaggatttagtggagaggctgttttgactatttcttttcttttcttttcttttgagacagagtgtcgctctgtctcccaggctggatggagtgcagtggcacgatctcggctcactgcaagctctgcctcccgggtttacgccattctcctgcctcagcctcccgagtagctgggactacaggcgcccactaccatgcccggctaattttatgtacttttagtagagaccgggtttcaccgtggtaaccaggatggtctccatctcctgacctcgtgatccgcccacctcggcctcccaaagtgctgggattacaggcgtgagccaccacgcccggcctgactatttctgacatctgacttaggctgcacaggaggtggggtttcttgacagggaggagctaatgtagggactgtgatgtgccaggctatttgggttggggtggagaaaccacagagagacagacataagctctctcccttatttataggacatacctactggtcctgccctaggccccagattctttgttagtggccttttctactgggagcaggtggggcattccagtttcaggtgttctgggacctggcttgaagtttttcactgatggctgcatcattaggctcgctcttttgccctttcctcagttcctgtctttttttcactttcagtcacctagaaacgacaatatccaatcagaagttgagaatgagacaagtttgggaagacattgaggaatgtctcatattgtggtattgataaatctagagatggggccacagcttgcttatagctgcttagagtaaaatgattaatcagaaaaagtaatttccaaggatttgtagtcagtctgcctgaggctaatacatttattcacagcaaaatatctgctgcctaaaatgactctgcaagttacccctacaataccagctactcagagtgatgcaatcacctggttgcaataggaaattatcctggcttcagttatctagtagaacaggtgtacatatcaatcttagagctcttgagaagacccagtagccccagacccgtgcaattatattataagcactcaagtaacttctcagctaaaggaagaatgatgaagcaggaaagagagaaaaatgatttgtattttttgtggttaacttgcttagaaattttagggaggataaactcaatcttgactaataggaaatttaattaatttagagagttattaaataatagctcctccacatcagggactatgataaatgttattaacaacacaaagaagaataagactttcccttctaggaacataccatttagtgggaagaaagacagacagatacacacacacatacacacacacatgcacatacacttaaacagaagtggtagaggctgagggaaatcccataagatagacataaagaaagtgctccatttgctcagagttagaggtgaaaaccaagaatattggcagaaaagaatgttttaaagcaactttgaatgattcttccaatgatattggaattagaaaatgaaggtttaggcagagtggggagcaggacagtcactgaagtgggaaggcacacatgggctcagcaaaaccggagcacagtgtaatatcattaggggtgaagtcaagaaaagtagcttaaaattaagccatagagaatccaaagattttaaattttcttttgatttcaaaaatgatcttttcatattattgagccagaaaataattaagtcatctatatattagacaaagttgtcaaaagcaactaaatggagggatgttaaaatgggaaagaaaaaagctagcacatttaacctatagctaacaatactgtattatacacttaaaaatgtgttagcagggtaagtctcatagcacaaacaataaaataaatttcttaaagaaaaagttaactattggaatagcctagacaagaaattatgaggctttgaactgaaacaacaggaacagaatttgaaagaggagaataaacccttgggatacagaatgaacaaaattttaacactgtctgctgtaaaaagtgagggagatcagagggattaaggtgacccttggatttcaagaataaaaatatggccaacaaatccagggaacacagatgaaagagaatattcaataaagaagacatacaaattcaaatggggtcattctgaaattgtggcacatttgagatatcctcatatctatccttataatcaaaacaaactcactatctgctcattctatgaccagtgacctcactcactgctgccttatacttcagggcttacacgtagacacacacacacacaggcacacacacacacacacacacacacacacactaagaaaagtagcttaaaattagaccatagagaatctaaaattttaaaatttagaacagatcttcatctgagccaggaaccattcatctatggcttctgtcatttaatagaataaacaaaatctgcatatgaatccatgcagaactccaagttcagcatggtttctcactgttctcagagctggtacctgaagctgcaggtgtgcattctctgccacactctgtaatggatgagtggaaattcttccataaagcttttgtctattgggagcaggtaagtctaggcaaagtatgcacaatttttttttctgggatacccagtggaaaaaaatagaaaagcatcatttttaaagtactgaaagaaaaaaagtcaacctgaaacaacctcattctagccagggaaaattagtcatttcaagaaaataagagacaatcagactagaaaggaagatataaaacaatctctaactacagttgacacttgacataatcttgtatatagaaaatatgaattctcatacacatacacatgtacacagacaactccactagatttaataggcaagctcagcaaggtgcagaataaaagattgataccaaaagttctattgtatgtctgtatgttagcaatgatatgaaaatgaaattaagagcagaattatgtgtataattccaacaaaataataaaatatcttggcataaattaaacaacaacaaaaaaaaaaaacagaaaagacttgtgggctgaaaggtgcaaaatattgttgaaattaaagacctaatagaaagatactccatgttcatgggttggagggcttaacattgttaagtggcaacactccccaaattgatttatagattcatctctgtcaaaatttcaaaattctagttgtattttttttttggaaactgataaaccaaagtaaaaattcatatggaagtcccaagtaccaagatcagccaaaacaatgttgtaaaagtagaaaaaatgttgggcaactcacacttcacaatttcaaagcttattactaaactacattattcaaaacagtatggttctggaacaggataaacatataaatcaatggaatagaattgagaaccctcaaataaattcataaatttatgggcaattaattttagacaagagtgccagccaagaccattcaatggggaaagaatggtaaatggtaccaggaaaactgtgtatgtatgtgtaaaagagtgaagttgtatcttgtctcataccataaacaaaaaataactcaaaatgaattaaagacctaaatgtagaagctaaaactcttggaagaaggcataggtatacatctttgtgaccttggtgtgtatgtaaccagcagcaaatccatatgggtctgcagtaaactcaattctagctcctaggaggagagaatttggccaaggggcagaaagaagtttaaggcagaggaaaagacccgggcaagttttagagtagtagtaaaaggaagcaaagtatacttggaagagggccaagcgggtgacctgagagacctaagggccctgtttagcccttgacttagggttttacacatcaccatggttctagggtttgtgtttctcctcccttgatgttttcaccttggggcaagctgtctgtgtgctcagtggcctgccagcacttgggaggggctgctcatgtagtgttcttactggagttgcgcacatgctcacttgaggcatttttcccttaccagtggggtgttcctagagtcatatgttagttaaactccgtcatttagcctctgtgcacatgcttgagcccactcgcccaactccagagatcttatcgggaagctgctgattacaagctccagatgtttttttatctatgtggaaactgtctttcccggatgctggttgtgactaattatcatctttgagagacagtttaacaaccacctgaccatcacctgatgatcacctgacattctggagtgtgtgtggtgggggtcggggggaggggggagagggggtctcttctcgtgccctcttcatatctgcctacctattctaacaggtatacatgaagcagattcgctgtgcactgttactaattccaggggattgtgttaattttccagggagaaatgcatgaaggatagtggaggtcatcaccatgccaaccaccacttcacagcccactgcatcttgaactgcaatttccatcacttgcctgattcatataacaagttgagcaaagcaaatttattactcacagacaggcagcaaaggacagtagaagcttaggattcatggtgagtttgtctctcaaggctcagaaaaactacacaggatggatagaatcttgcctgcatatgcctcatgttgcattgcagctgagtggctctgaaagtgcactctgtcctgggttttaaacccaggggctacatttaatgggttaaagcactgtgggacatcctgttccaggagagacaagaacagaggccaggattttcctgccagttcctcattatcacaggatgtggtattgctagcacatcctacagttattcttaagaactataaaagagaaaagggagatccacattgccaaggccatccagggacttatccttcagagtaggcagtgacttcttaaatatgaaactcaaaacacaggcaaccaaagaaaaagataaatttgacttaataacattttttaaagtctgtgcttcaaaggacactttcaagaaagacaaccccaaaatggatatatacttgcaaatcatatatctcacagggaattgtatcaaggatatataaagaactcttacaactcaataatataaagacaaataacctaatttaaaaatgagaaaggatctaaacatgtctccagagaagatctgcaaatggccaaaaaatacatgaaagatgctcagcatcattagtcgttagtgaaatgcaaatcaaaatcacaatgagataccacttcacacccagtaggctgtaataaagatacccagacaatagcaggtgtaggcatagatgtgaggaaattgggaccctcaagaattgctggtgccattgtgtaaaacagtccagcagttactcaaaagttaaacatagaatgaccatgtaacccagccatccctctcctaggtatacccctcagacaataaaaaatatgttcacgtaaaaaatttatacacacacttcaaacagtattattcatattactcaaaaagtggaaatatccatcaattgatgagtggattaactaaataggttttatttctaaaataaaactggtgataaaaaggaacaaagcactgatacatgctataccatggatgaacattgaaaagctatataaagtgaagaaggcaggcacaaaggggcacatattgttggacttcatttatataaaatgtctagaatagaccgggtgcagtgactcacgcctgtaatcccagcactttgggtggctgaggcaggcggatcatgaggtcaagagatcgagaccatcctggccaacatggtgaaaccccgtctatactaaaaatacaaaaattagcttgtagtggtgcgcgctcgtagtcccagctactcaggaggctgaggcagaagaatcacttgaacccgggaggcagaggttgcagtgagccgagatcgcaccactgcactccagcctggcaatagagcaagactcagtctccaacaacaaaaacagagtctaaaataggcaaattcttaaagacggaaaatagattaatgattgccatgggctgtgggaaggaataaaagtgaaatgacatctaatgataaagaatttctttctggggtgatagaaatattctggaattcatggtgacagttacagctttgtgaatatactaaaaaccacttaattatatatttgaaagggtggatgttatggtatgcaaattatatttcaattttaaagaaaatgtcaacactcaacatgaaaatattcaaaattacagctccaacatcagaataaagactatatttttggatctctaggattctgatatgagtaagaccatgagtcattattatttggacactaaatgttaacatgatcttatttattattcaagtcatacacctaactcctctggggtgcctatccaatggagtgagattgtgccttgtttcctgtatctttctttcactactcctgggacaaagtagactttcacataatttttattcaatgctgcaggatgagaaaggacagaaaaatgggaggaagaggctgggcgtggtggctcacgcctataatcccagcacttcaggaggccgaggtgggcagatcatgaggtcaggagatcgagatcatcctggctaacacgatgaaacccagtctctactaaaaacacaaaaaattagccaggcgtggtggtgggcgcctgtagtcccagctactcgggaggctgaggtaggagaatggcgtgaacccaggaggtggagcttgcagtgagccgagatcacgccactgcactccagcctgggtgacagagtgagactctgtctcaaataaataaataaaaaataaaaagggaggaaggaagatctctcaaacacaggcatcccatgcatgactacagagaatgatacagataggtatgcagaataacgggacctgaggtcagagggggaagtctttttagagtttgttctttgaatcacttatattgaaaattcaagtggaataagtgaaggtgacaaaagtgaattacaaatcttaaagttccctgaaaatgcttgaagccatcccttagctgaggtgtgggagtgaaaaagcaaactgagacaatgtgaaatcattttctatctcgaattttccctccagcaatgttggtgtccacttccctgtctcttaatgggtgcatctatatatcacctcttgtcaatacctctactcagcaacagccagaaaatagaaagattatataagccaataaaaggaaaataaaggaacaaaaaataagaatagtggagagatcatctacttgggaggctgaggtggggaggattgcttgagcccaggaatttgggaccagcctgggcaaacagcaagaccccatttatgaaaaaaatgaataacattatctgggtatggtggcttgtagtcctagctacttaggaggctgagatgaaggactcacttgactgatcctaggagattgaggctgtaatgagatatgattgcactgctgcactccagcctgggcagcggagctagatccagtcttgaaaaaaaaagaaaaaaaaggtgaagagggaaaaaaaagaacgagtaatagaggtgcttacttcacaacactaacctcacaaacacacactaagctaggttgtgtgtataggtcagaacaaaagatctaccatttaactgacatataagattggttctcgaaaccataggacccactggaaatggtgacctcacaggaagatgcatcttgtaggaggcagctgtgaggtctggttccccgacgtgctgcagcaagtgcctttgccctgcctgtgggctccctccatggccaactctgctatggacaccagagtactctgctgtgcggtcatctgtcttctgggggcaggtgagttttcagctaaaggatcaccatcactgggctttgttttgggctctacagcagattctcaaatataccctggacctctgtgttgaccaaatattttgtgaaaggtattgacatttatatgaaaacaaataattgcattatggagtaaaaagcaaaattcatgtgagtttttaaatgaacgcaggagacttcaaacaggctccttcactgtaagacattcatccttctgccattacaactctgtctcatgcagtctcttctcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccacccacattgatgcagagccacatcctctcagtccacaaacatcctccagacctgccttggaaacagcggtgggccaggaagggaaacgcgttacctgtacagtgaacaggtcagctctacggtattctgcaagttgagggtggaaataggggaggattgtaggaatagcatgaaacatcccaggctacgctcagaaactaagactctgtcatccaaagaacataaagatttttaagaactagacataatttttcagtttcaacattgacttaatttgtcagtttcaaaacacttagcagtgtaactctgttttttactccacactgtatgtcaagttctatatttcatgctttacatcaataattttatttaatcaccaagacacacaagcaaaggaagtgctttcttccttttcaccaagagaaattatggtcctaggagttaatttttagaaagaaagagacagagagatgggggaagaaaggggaggggaggggacaggaggagaagggaagggaggggaagggaggggaggggaggggaggggagggaagggagaaggaaacctagtaggtggcaaaaagcatttggctcaaagggttatgatttttatctcacatcatgctgcttagcattcttttaggcataatccttgttctgttccttgctgagtacccgtgcaggtttttacggatgctaggttcaagaattcctgctataaaattatagaacatctgagagatgatggaaatagagttggataaatttgtctagaatttagggaaaaggtctggcccacagatattgttcattagaaatgtgtcacctcaactttttgtcttaatgtttgtttttattctcatcactcaacagatataggccacctacagaaaaagatttgttataatttgctttgatgaaacaatttcataaaatcaaaaggcagacaaaagcaaagtcatttcaaatatatgtgcagactaagtccagcctcaccagcttggagtataaaccatgtgattccactgcagtttttgccctttgattttctaaaatcatttaatgtactcctgcccctccctcactttacccaaaaggagaaaaacccagaaaatcttccaggaagacagaagagggacaccggcttgggagcctgagaaagatccagagagatttccagaaaaagaccaaccctgagaccccagcaaggctgcagagaagatggattccaaacttcatgccatttaaagcaccagacatgtaatttaaagaaacagtcttccaaaggtagtgctttacagggaggggaaaaaaaggcaaagaggaagaaagagggtcttctggcaattcaatagtgaggagaaaaagaggaaaaaggggaaaactgagaattctgcaaaacaaaaggaaatcacaaatcaagaggacccacaaccagccccactacgaaaacaaacaaagctcactaaggagtctggattttgctagaatgatggccaaaggaacattagactaggaattttgtaaaacacctcaataacacgaaaatgagcaagatgaaagtaatacccgtacaacaaaggaaaacatctcacctctgttccctgttccctcatctcaaaagcaatcatgagtcagaagataatgtaagtctacactccaaacagaaataaatacactcaaggaagcagctgaggatataagtgaccataaccagaccaggactttaaaaactcagactacaaatggccaaaatgggaagacatcagaaaaaaacacaaattgattgaacccaggagggacatgaaagaaaaagacaaagttatcccagtcatgcaaaataaaagatgaccaagggagaataaacccaaatgaaaatttagtcaggacattgaacaaaggcaaagaaacaagtagcagaatgagaaggacatgagtgaaaccagccagttagaaggcggtcaaagaaggcgaggtcttggtatgattgcatgaggggcctggaacagcagcactgggctctgtgcagcaggacggctaagcagcaggttgtcacagtggccacagcactactggccagaccccaggagtcacagtttccctgagagagctgagggcataaacaatgataagttctccaggggatggacttcttaaatactctgagttcatcattacacattctatgcatgtagcaaaataccacaggcacccacaaataggtacacatattatgtatcaatgtttttttaaaaaaaggaaaaataaatgaattccacattcttgtataatcagagtatctacagcgctcctggagtaacccaaaccttatggttgctggaaagataaaaaaccaatgggccaattggggtgaaactctggcccggaaacgtggggtgccagccccctcagcacagatgcaatgcagagttatgggaggtgcgaatgactctgctctctgtcctgtctcctcatctgcaaaattaggaagcctgtcttgattatctccaggaacctcccacctcttcattccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtttcctgggagcaagtgagtcctgggttcagggagaaaattcctatctggagtgctgcaagttccaaatctaaggcctccccgagggacagcagcatcaggcgcctccctgggctgtactcaggcatgcctctctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtatagacacagtgaagcacggatgtcgcctctctgtgcataaatgtgcccagtcctgcttccccgaccaggtgacagggctcctctgcactctatgatggcaggaaacgccactcagccactaagcaggtttaaaaaactgtatataactaaaactctatatataaactatgcatataaaactaaactatatatgtatacatttatatataactaaaactttatatgagactaaaatgatagttttatatagttttttaaagtatagttttatatatatataactatatatatatatcattttttaaactatagttttgtagttttatttatttatttactttttggagatggagtctcactctgttgcccaggctgcagtgcagtggcatgatctcagctcactgcaatctctgcctcctgggttcaagcaattttcctgcctcagcctcccaagtagctgggattacaggtgcataccaccacacctggctaatttttgtattttagtagaggcagggtttcaccatgttggccaggatggtctcgaactcctgacctcaggtgatccacccacctcggcctcccaaagtgctgggattacaggcatgagtcaccgtgcctggctgttttatagtttcatatagttatttttaaaaactatataaaagtttttgtatagccacttagtggctgagtgaagtttcctgtcatatatgatatagatatagatatgtttatatatgatatagatacagatatgttatatatatgttatatgttgtatataagatatatacatatagagagagtcagagagacacagagaagaaggaaaagttaatcttacaacccccagcttttttctattttaccgaatgctagatgaatagatggatgaatgaatagaaatgaatgaatgaatagaaaattttcccttctttcaggaagataaaaaagcctgtggaaagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 103 - DNA, 145035 bp, Homo sapiens
aaaaaaaggaaaaataaatgaattccacattcttgtataatcagagtatctacagcgctcctggagtaacccaaaccttatggttgctggaaagataaaaaaccaatgggccaattggggtgaaactctggcccggaaacgtggggtgccagccccctcagcacagatgcaatgcagagttatgggaggtgcgaatgactctgctctctgtcctgtctcctcatctgcaaaattaggaagcctgtcttgattatctccaggaacctcccacctcttcattccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtttcctgggagcaagtgagtcctgggttcagggagaaaattcctatctggagtgctgcaagttccaaatctaaggcctccccgagggacagcagcatcaggcgcctccctgggctgtactcaggcatgcctctctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtatagacacagtgaagcacggatgtcgcctctctgtgcataaatgtgcccagtcctgcttccccgaccaggtgacagggctcctctgcactctatgatggcaggaaacgccactcagccactaagcaggtttaaaaaactgtatataactaaaactctatatataaactatgcatataaaactaaactatatatgtatacatttatatataactaaaactttatatgagactaaaatgatagttttatatagttttttaaagtatagttttatatatatataactatatatatatatcattttttaaactatagttttgtagttttatttatttatttactttttggagatggagtctcactctgttgcccaggctgcagtgcagtggcatgatctcagctcactgcaatctctgcctcctgggttcaagcaattttcctgcctcagcctcccaagtagctgggattacaggtgcataccaccacacctggctaatttttgtattttagtagaggcagggtttcaccatgttggccaggatggtctcgaactcctgacctcaggtgatccacccacctcggcctcccaaagtgctgggattacaggcatgagtcaccgtgcctggctgttttatagtttcatatagttatttttaaaaactatataaaagtttttgtatagccacttagtggctgagtgaagtttcctgtcatatatgatatagatatagatatgtttatatatgatatagatacagatatgttatatatatgttatatgttgtatataagatatatacatatagagagagtcagagagacacagagaagaaggaaaagttaatcttacaacccccagcttttttctattttaccgaatgctagatgaatagatggatgaatgaatagaaatgaatgaatgaatagaaaattttcccttctttcaggaagataaaaaagcctgtggaaagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcct

SEQ ID NO: 104 - DNA, 130858 bp, Homo sapiens
aatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcct

SEQ ID NO: 105 - DNA, 133838 bp, Homo sapiens
actgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcct

SEQ ID NO: 106 - DNA, 32785 bp, Homo sapiens
atcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctcc

SEQ ID NO: 107 - DNA, 124461 bp, Homo sapiens
ggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcct

SEQ ID NO: 108 - DNA, 48609 bp, Homo sapiens
aactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcct

SEQ ID NO: 109 - DNA, 146701 bp, Homo sapiens
atttggctcaaagggttatgatttttatctcacatcatgctgcttagcattcttttaggcataatccttgttctgttccttgctgagtacccgtgcaggtttttacggatgctaggttcaagaattcctgctataaaattatagaacatctgagagatgatggaaatagagttggataaatttgtctagaatttagggaaaaggtctggcccacagatattgttcattagaaatgtgtcacctcaactttttgtcttaatgtttgtttttattctcatcactcaacagatataggccacctacagaaaaagatttgttataatttgctttgatgaaacaatttcataaaatcaaaaggcagacaaaagcaaagtcatttcaaatatatgtgcagactaagtccagcctcaccagcttggagtataaaccatgtgattccactgcagtttttgccctttgattttctaaaatcatttaatgtactcctgcccctccctcactttacccaaaaggagaaaaacccagaaaatcttccaggaagacagaagagggacaccggcttgggagcctgagaaagatccagagagatttccagaaaaagaccaaccctgagaccccagcaaggctgcagagaagatggattccaaacttcatgccatttaaagcaccagacatgtaatttaaagaaacagtcttccaaaggtagtgctttacagggaggggaaaaaaaggcaaagaggaagaaagagggtcttctggcaattcaatagtgaggagaaaaagaggaaaaaggggaaaactgagaattctgcaaaacaaaaggaaatcacaaatcaagaggacccacaaccagccccactacgaaaacaaacaaagctcactaaggagtctggattttgctagaatgatggccaaaggaacattagactaggaattttgtaaaacacctcaataacacgaaaatgagcaagatgaaagtaatacccgtacaacaaaggaaaacatctcacctctgttccctgttccctcatctcaaaagcaatcatgagtcagaagataatgtaagtctacactccaaacagaaataaatacactcaaggaagcagctgaggatataagtgaccataaccagaccaggactttaaaaactcagactacaaatggccaaaatgggaagacatcagaaaaaaacacaaattgattgaacccaggagggacatgaaagaaaaagacaaagttatcccagtcatgcaaaataaaagatgaccaagggagaataaacccaaatgaaaatttagtcaggacattgaacaaaggcaaagaaacaagtagcagaatgagaaggacatgagtgaaaccagccagttagaaggcggtcaaagaaggcgaggtcttggtatgattgcatgaggggcctggaacagcagcactgggctctgtgcagcaggacggctaagcagcaggttgtcacagtggccacagcactactggccagaccccaggagtcacagtttccctgagagagctgagggcataaacaatgataagttctccaggggatggacttcttaaatactctgagttcatcattacacattctatgcatgtagcaaaataccacaggcacccacaaataggtacacatattatgtatcaatgtttttttaaaaaaaggaaaaataaatgaattccacattcttgtataatcagagtatctacagcgctcctggagtaacccaaaccttatggttgctggaaagataaaaaaccaatgggccaattggggtgaaactctggcccggaaacgtggggtgccagccccctcagcacagatgcaatgcagagttatgggaggtgcgaatgactctgctctctgtcctgtctcctcatctgcaaaattaggaagcctgtcttgattatctccaggaacctcccacctcttcattccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtttcctgggagcaagtgagtcctgggttcagggagaaaattcctatctggagtgctgcaagttccaaatctaaggcctccccgagggacagcagcatcaggcgcctccctgggctgtactcaggcatgcctctctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtatagacacagtgaagcacggatgtcgcctctctgtgcataaatgtgcccagtcctgcttccccgaccaggtgacagggctcctctgcactctatgatggcaggaaacgccactcagccactaagcaggtttaaaaaactgtatataactaaaactctatatataaactatgcatataaaactaaactatatatgtatacatttatatataactaaaactttatatgagactaaaatgatagttttatatagttttttaaagtatagttttatatatatataactatatatatatatcattttttaaactatagttttgtagttttatttatttatttactttttggagatggagtctcactctgttgcccaggctgcagtgcagtggcatgatctcagctcactgcaatctctgcctcctgggttcaagcaattttcctgcctcagcctcccaagtagctgggattacaggtgcataccaccacacctggctaatttttgtattttagtagaggcagggtttcaccatgttggccaggatggtctcgaactcctgacctcaggtgatccacccacctcggcctcccaaagtgctgggattacaggcatgagtcaccgtgcctggctgttttatagtttcatatagttatttttaaaaactatataaaagtttttgtatagccacttagtggctgagtgaagtttcctgtcatatatgatatagatatagatatgtttatatatgatatagatacagatatgttatatatatgttatatgttgtatataagatatatacatatagagagagtcagagagacacagagaagaaggaaaagttaatcttacaacccccagcttttttctattttaccgaatgctagatgaatagatggatgaatgaatagaaatgaatgaatgaatagaaaattttcccttctttcaggaagataaaaaagcctgtggaaagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcct

SEQ ID NO: 110 - DNA, 98139 bp, Homo sapiens
gacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggt

SEQ ID NO: 111 - DNA, 132410 bp, Homo sapiens
tccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatgagtcagtgaagaaaagaatgaaagtttactgtttagcagtgtggatctctaatccgacttaaaactccttgttcccgattcctattcctcctaagccagagatccctgggtccagggtgagggcacggcattcatgcttacccacgggctggtcaacaaagaggtgctgacctgagagtagggcacataacctcagccactggggtacacttaccacccccgcccccgtgtagctccctcccctatcctgaaatctcccttagcacactaagtattctaggttaaacagcccagatgttcagggagttcattcgccacaaacacacattaaaatgcagacaatttgcctgtgagatgaggaaaattctctggaagatttaggccctgagagctgaaaagggaccctaaacattacctggtgacaactgccctgaggccagagaagagaactcacaatattggtatattaaccggtaccatttgtagttaggctgtcattaatctgggtgtaatggggctcagctacagagaagcgtatccagaggaaatgtggggttcctgcagtcagctggggcaccgaaaagacccagactttagaaccagataaaggctgagttcgaacctctggttcttttgtgatgtggtgaccttgggcaaattaatgtgtgaacctcagtttcctcaactataaaatgtaatgaacaatacctaccacttactattgctgtgaggaagaaaagagagtcaacatgtaccgtgtacagattattgatgtaattcaatggttcttttccccatcctcctaggaggtcactggggagacagggggcagggtcagcccagtgccaaaggatgggcaggatctgaagtgtggaaatggagtaaggctgtgtctgtgtcagaggtgggttgggaagatgtgagacaaacatcacaattttgcctaaggtgaatccaacccacaagtagagcacaggccaacagcagctcactagtacacatacttacaccagcagctcactagtacacacacttacaccagacgctcactggtacacactcacaccagagctcattagaacacacacaccgtcagcttgctagtacacacacttacaccagaagctcactagtatacacttacaccagaagctcactagtacacacacttactccagaagctcactagtacacacacttacacccacagagacaagccccacaccacacggactcacaaatgcagaagaagagttgaccctgccctcatgtacagatagtatgctggtgtgtagtgagaggcggctagtgttcgccacgcctgttgcatcaataactattccacagaacagcatacatggtcaaggaatatttttaatatttacaatgaggactgagtgtttgctaaatgaagaaatcaaaggagtacattctggagggctggtagactcccagagccagggtttttgagatgagagtgaaaataagcaggctgagagcagaaagaaagaaagttctgcagatagaagttaggatattaccacttcggccccagcccagccagtaaatgtttagaagcatagtagtaattagcaggtaggagttgtggggaggaaaggaaactgacatgatgggaagcaggaccagctacaaaatcttcaggaccagctcagaatgaaaatgccggggctcgtgttaaatcttaggatttcaacatggtgacagcagagcactaaaccaagcagggggcccttctagcaggaggccccatggggacctaggaaggaggtcacatccatacaaatgtaaagaaatgtcagagtaaatttcctccattgtccaggagattcggaataggttctcctaagactgatatttcttcattttaatagagttgctcagaaatgaaaaacaatcaatgggaagaaaaagaaaaaaaaaaaagataagatgagtaggagggcaggtccaaaagaagtgattcagcaaaatgaaaggggtcctcagggattaaaggggatgaatttacctgtcatccctaagaatctacaaaggagatgctcaggacagaaactgtatcaacacaactagtagcaagaagttactctgatgatatcagatgtttatttgggaaacttgctagtagagaaagctacatataatatttggatgcaaagggacacagaaggttgaagagtccctaattttgaaataagggaagatgactaactgtctgagctgagaaaactcaggggtacctggaggcagaggaatggataagatgacttcatgcaccacaaaaagaaaaaacctcacattctcatgaacgcactgtaaaaccaaaggatgtcctcatgtgaatgcaaaaaataggccatctgtaaatccaaagaaagcccccagatctaaaatgtctccctcatcccagattccccttcattcctgagcaccttagatttggtataaataacctgcttgggagggggctttttgaattcgtacataatttaaccttcacacagtttctgcaaagtcagaatggtgattattacctcacatgcagaaaaaagtgataggaatttctgtcttaaaagtcttgttggtggacaaaggaagttctaggatttggatcttgtttttttgggttccaatcccttgctccagttaaaaaactaccacataaaatggtgagaagtaggtaggcaagtttttattgatagagaggaaatcaaataatggcaatgaggagacatcacctggaatgttaggcagtgcctaactgggggatggacagacaatgggcagtgccaacccatagggtggatacaaaagacaggcaaggaaggggtagaaccatcaaagaggaataggctggtgaccccaaagcaaggaggacctagtaacataattgtgcttcattatggtcctttcccggccttctctctcacacatacacagagcccctaccaggaccagacagctctcagagcaaccctagccccattacctcttccctttccagaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcggacaagactagatccagaagaaagccagagtggacaaggtgggatgatcaaggttcacagggtcagcaaagcacggtgtgcacttcccccaccaagaagcatagaggctgaatggagcacctcaagctcattcttccttcagatcctgacaccttagagctaagctttcaagtctccctgaggaccagccatacagctcagcatctgagtggtgtgcatcccattctcttctggggtcctggtttcctaagatcatagtgaccacttcgctggcactggagcagcatgagggagacagaaccagggctatcaaaggaggctgactttgtactatctgatatgcatgtgtttgtggcctgtgagtctgtgatgtaaggctcaatgtccttacaaagcagcattctctcatccatttttcttcccctgttttctttcagactgtggcttcacctccggtaagtgagtctctcctttttctctctatctttcgccgtctctgctctcgaaccagggcatggagaatccacggacacaggggcgtgagggaggccagagccacctgtgcacaggtgcctacatgctctgttcttgtcaacagagtcttaccagcaaggggtcctgtctgccaccatcctctatgagatcttgctagggaaggccaccttgtatgccgtgctggtcagtgccctcgtgctgatggccatggtaaggaggagggtgggatagggcagatgatgggggcaggggatggaacatcacacatgggcataaaggaatctcagagccagagcacagcctaatatatcctatcacctcaatgaaaccataatgaagccagactggggagaaaatgcagggaatatcacagaatgcatcatgggaggatggagacaaccagcgagccctactcaaattaggcctcagagcccgcctcccctgccctactcctgctgtgccatagcccctgaaaccctgaaaatgttctctcttccacaggtcaagagaaaggattccagaggctagctccaaaaccatcccaggtcattcttcatcctcacccaggattctcctgtacctgctcccaatctgtgttcctaaaagtgattctcactctgcttctcatctcctacttacatgaatacttctctcttttttctgtttccctgaagattgagctcccaacccccaagtacgaaataggctaaaccaataaaaaatggtgtgttgggcctggttgcatttcaggagtgtctgtggagttctgctcatcactgacttatcttctgatttagggaaagcagcattcccttggacatctgaagtgacagccctctttctctccacccaatgctgctttctcctgttcatcctgatggaagtcctcaaacaccatttccatacccaggcattctgggtccccactggagggttagtctgaagggcaatggctgggctttggaaaaccagcaagatgaggacagagaggaaggcacacagcaaaccataagcccttacccagtgcaggacagaggatgcgggcagacctatgggttacaatgtctggtcatttcccaattccagattaaactgtcacctgttttacctttagttttattagtttgtagtcttaacacctccagcttctcttgtttcaggatttgggcttaaaattgagtgctactctgcatgtctagtttgaaatactagagaaggcagagttgagacaactgatatgtaaagcctggggaagagtgatttctcaggagcgagacacactaagtcaggagcaatgggatatagggcccagtgggggctgaagtgctatgttcagagtagcccttccaatgggcttcttcgtttgatggatggaaaccaaaccactccaaacacaaggtgttaactgctcctacttgggcaaagacagttatcctgtcaaggtaaattctgcatacaggctgaatgcattgtggtaaaacactacatggaggaagaggaggaatgggattaaagaaaaggaggcctagaacagtgagaggggctgagagaggccatgtcgaagttagttgaggaagactgtcaggggagagaagagaagtctgaaagcagagaaaggttgggaaagaggagggagccctttgttgagagcctgcttgcttcaggcctcaggctggacgctgctacctgtgctgtctgcatctgcacaatgatcccaggaacaggtattattttccccatgttatagatgtggaaactgaagattacagttcaaattacttatgagttgtgaaaccgtggcatgttctgctgaagatggcaattctggaaactttttccaagtagttaccaggatggtgggattgctcctggtatctgggtgatcctagagcagcttctcccaaactccaggcagggcccatggtaacacactgaagacaccttaatgccttggtgtctttgtttcccacggctgccgtaacaaagtaccactggtgggtttaaaacaataaaaacttattctctcacagttctggaggctaaagatacaacaccaagatgtcagcgggtcatcctgtatgacagctctaggggagaatcctttcctgcttcttcccatgtctgatggcttctggcactccttggcttgtgccagcatcgcagcaatctctgcctctgtcttcacatggcattttccctgtgtctctgcatttaagctcccctctcctttctcttttcaaggcatggtcttaggatttagggcccaccctaaatccagaacaattttattgagagatcttaacaaattatacctgccaagtccctatttccaaataaggtcacattctgagtttctgagtgggcatgaattctgggggaacactcttcttcccactacactggggatcttggaactggagaagagggttctctggtggcagcttgcaaagaccaggaaaggatgtgctcacagcagggatggggcccaggaaactcatcacatgccggtcatttccatcagtcgtaactatctctagactgctcaaaatgcagtatagtattttgttggctattgttgttacatatgtgctggtttgttttcatattggctaaaaaaaagcctaaaacaaaggggacaggctttaggccctagaccaacattcatgcttcccactccttagacctgcgtggaggcagcaggcatatccttgtggctcctcgcaaaggtaggacaggaggatgagcagccgagggaacaaggaagcacttcagagagagcagaactgtgggggccagagggcacaggctaggactggggatattggaggatagtggtttgtgtgggcagagctgtgaggggctgagcagctgtagtgcaagattagagtggaggtgggaagggggaaacaccttgtagaagaaagatagtgtctgttagtttgatggccatcatcttggggacgtggaaaacggaggcattagcaggtgggaggatgtgggaggagtttcttgttagtaccctagagtttgcaatcagacccaggtgaatgaattctcctctggaggataaaaggccatgtgaattttaccctctcagtccaggggacttgacagagatggagagagcttcaagctccatctggtcctcccaacaccctacttgacccagggcaggttcctcttcccaagtttttacagccatttccttgtctctctcaaacaacacccccaacattcagcacgcatgcactgggaagtgaatctcttctgcctctacctgcctttttctctagaatcgaagtggattcttctgggccaattctgggcatcctctccattcttcctcaggtaacactgagaaaagatgagttcgatgtagggcaatcatataacttactgtaagaattgagataccattgaaaatgaaaggggcccattagccacatgggatgctggaacaagaggagtaaaccaggaatggtcacaaggcccctccagtggagaggctctgagggagtttctgggtgcagcattattcctgcaaagggaggtactaaagggactccacaccaacctggacttgttgactgtttcaaacctcagggctgacctaagcatcatcctatgaagaaaccatgtggacagaatatagggcaaggcagggacaacagcatcctacacaggtgacacccagtgcagagcaaagcatgcttacttattgaaaagagttacaagaaaagcatctctggaagaatgtctagggtaccccaagttctcgctgaacttagcatggagtagctcttaaagagaagaacttcacctgtgacctttacagatttatttgggaaattggaagaaaaagggggtcatccaaatggttgcgtaataaaataacttctttgtgggggaaatgggattcccgtgagcatcccagagccccagtcaccatcacttcctgagaggaagaatcttcccatcagcaccagtatccatagagattttcctactactaggctcattgctgggccacataaggttggggagtggggatggtcgggagctgctgggacaatccaagagaaaaaggctttttctctctcgagggagtgatttcataataagagtttgagataagggcaatggatcctaatagatattaaagtctccatttccgtccctgagccatttcctcatttttcttctgtagtggcccagaaaggaggggtggagatagactgatatcagcccctaacagtctgtgtgacacacagccccaaatgtcctatataggagaatctttgtgaggtttctctggttataaatgaatgtgggaatggaatattggtgctttgagacctctgttgaagctgcatagtgaaaacaaaaatgagtttttgcttcttcctcaggtaacactgagcaaagatgtctagccatattttcatttaggggtgttgggagatgctggtggagatcacgggaatggctaaaacccagaggtgaactcagctttgccatggacccatgagtgaatccattttctgcttctctactgacatctcagactcatcaccaggttcacttttaccatgtcctagaaactcccctatgctatataagaagactcatagtatagaatggcatgaagcatggccaacagttttaatcacagttcatttccattgcttgtggcaaactcccatggctcccaaaaagctgatttctgaggcttgggaccccataacctaagactacccaacccacctagactcaaacacaacatattccctgccttattctagggttgaatgttctttcctcctatctggaagccttccttttcttgctgtctgtgtttgtgaatttgaagttcctgggttccttaacatccctacatctctgcctgtccttttattttttttattgtggcagaacttatgaatcatctccctccaacagacatgatattttctattcgccatccccctctcctatagactcaactacatgcctttctctcccatctctatccatagtctttatctctgctgctggtggactcctgagagggcttcttggggaatatggggccccaaaaatgagtgaatggcttctgtaggtcagcaaaaaggatctgaaaatgagcctacacctgtgactatttccaaaggatttttatcagcttgctctgcaactgatctcaactgccctctgtgaatatgagcatttaatccacacaacatgtaaagctaattctcagctcctttttgccaacctacagttgctattcacttatctctgggaccctatagtccccccaaaagccctctcaggtgtctacatgcaacagagtgcccatattctggcaagaacccataaatctatgcgagacagaatcattagaaactttaaaacttgagtttttggaatggaaaaaaagcatgtagtggatggatgaaaacattatcatagcaaagaagatgttgtaatgcagagacctgggtttaagccttagttctgtcatttatcaactatgtgaccctgggcaagtgatcacctctgagactcagttttccttgctgtaaaatgagctcaattacaagcccaacttcataagatcgttttatctcatttaacccacacaacatgtaaagcttttagaacaatatcagtaagtattaggtgttattataactactaccaacctgaagatttttttcaggcaaaacattttcagttttctcaattttgttattatagggcacagttttgagcacgtcctactttccatagcccaatcactcccttctgaaaacattaaagtttgtttttatccctctatcttttaaaaaatgtgttgtacaggacctgacccagcaccaggtgggttctgacctacaaagagtaaagggggaactttgcctcctctttctcaacatcttatacgttagttggttccattaggacaatttatctactttttgtacgctcaccatcccgttgactcacagagctcactttgactcaccccctgggtgttttttcacatatccttctttcacatattccccttcctgtgttcatatagatggttttctctgtttggtgggggaggagggagagagagaatgtttatcatgtttattcagcttatctctccaacctattaagattctgcaggattctaattttgtgattcattatatttatccttctatcctcatgccatctcagatatgatcatcttgcctgattcattactataagagtgattcatgaaattcatagcaagatcacagctcaacagagaccccacattccccaagccttgtctgaagtccaggagctgctaaaacacagagaattagcttctggtcctcctctggccccagctgcatggctctgaacaactcatttttattctctgggcttatatgtcctcctctgtgatatgaggacattgggtaaagtgatctctaagaatcttcaaactctgctcttcagattctctgattcaaagcctgcagtctctgaagtaccaagagaatgggaactcagagaagctaagctcttcctggcctcaaatcatacatatctgtgacatagtctcagacagtctgatggtggaagaggacagcactggcactggagtcccacagttagcaagagtcaactggagccctgacacctgttccctggccctcctccatcaaaaaggtctagggccatgaatgacaagaaaattgtgttaaaaaggagagtggccctgaatcaaaaggtgggaagtaatgagatggaaatcggggtcttttaggtaatagctgacaactggggtaggaatgggggttctgagcccagtgctggctgccgggctgtttatctctgagtcacatcagcaccaagccacagcagccacctgccctagctccatctcttacagtcacaacaggatgtggtttgacatttactgggtcctgcatctggggtgcctgtgaaagttgctccctccacccacccaccttcagagcatcatgagaaccacactcaccgcatccggcacccaaccccctcctatgctgctctttctacctgggcccctggttagcatcctggcagtagaaatagaacttcagaggggaggggcagggtctctagaggggaatctaggtatcccagatccatgtgcaggcctcccctcccccaacacatctttacacctgctggaggttatgcacaagatcaaaggccacagtgggcaccatgaagatagtggagaatgaaaaacagctgcaataactgctctgacccagttgggatcccttctggtcccacatcactcaggcaactctctcttcccacctgccccccaaactcccttccacctccctccacatgtatcctcccacttccttccactcatgtaatgagaggtgctgatgagtcacaggagaggtagccctagataaccaacagactgcaaaacggacagtccctggatgtctgagccagtgtttgtgcactgcattgactggctcctcgtagttttttcctgtagttgctaaagcctgtaaggtctgtgtgatgaatattttctaacacatcttagaagaacataatgcaagacagaatgaaaaactagagaggcagaaacccccaaagtaagtagtgggaaattaccaggtatataataggtcaagcctgctctgcaggagctcaagggattgtagcattcttatcccaaaccactgaatcctgggcaaaaataagaagtcgcctaattttagtattaccagcttcccaaccccgggcattcttcatcttactcaagctgtccagaggccccagggtgactccctataagtcccatgggtggctgagatctatttagaggcacaagggtatctccttataagtcccatgggtggctgagatctatgagaagcatcttggggagagtgcctctggccaccagcatgtggccctgaatcttccatgtgcaactggccagggaaggagatatatggaaatagtcatcctgcacatctgcaaaatcagatgcaaatcctggaagctctcctagaaaagagacagcctcatctgattaaaggggcaagtgagtttgatgaattattggcaagagacagcatgtctgaacaggatcggtcatcctaaactgctttcctttgtcccctggaattataatgactgtggatttctgagtcctagatggtatggaaacagttatgggaatgaacagtcttgcatgaataagagcagataacatggaggatgttaatttgttctgctgaatttaggtggctttcaagcctctccttcaatgctcacctgtctctaggatgctctgtgcaatgatcaggactttttttcttcagattctctaaaacttacaatattcacatagacctgcacatttctacacaaactgactctcctgcttgcaatgtcattttgcttatataactattagcctcctaaagagctaaacttagctacaattttatgtcctttgtgaagttttccagaatttttgcagtatattacaggaaggaaaaatctgcctcaagtctctactaattctacttgactagtggtgattgcctgagacatttctctattaatgaggattctgaagctgtataaagcccctacagaatcagcatctgaataggcacagcatagggttcaagtttcatggttttgccatccaagcatgtttagcattttaaatattaatatttattacatacttgtagtttatgatttgaaattttttaactaagtcttcctcttgggtaagttgtaatgaaaataatcttgtaagcttaaggagcggaaaataatacctgttgaaaattagagcttgtaatagggctttataaacaccatctcatttaatacacataacaattcaatgaggcaagttttataggtggggaaaaacttgaaacttagtaaaattaaataactaggtcaagttcataacaactagcaaatttttagactacaaaaatcaagtgctttgactaaatcatgctatgactgtgcccaacaccatctcgagtacattttatttttctttttaatcctcaaaatgactcactgtgtccagcaaataatagctgcttaatacataggtgatccttaaagttcagtagggacccctgg

SEQ ID NO: 112 - DNA, 39730 bp, Homo sapiens
cttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagt

SEQ ID NO: 113 - DNA, 54333 bp, Homo sapiens
gacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcct

SEQ ID NO: 114 - DNA, 120784 bp, Homo sapiens
agggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 115 - DNA, 183907 bp, Homo sapiens
actgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacatttta

SEQ ID NO: 116 - DNA, 115802 bp, Homo sapiens
acttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 117 - DNA, 216081 bp, Homo sapiens
gttcagaatttcagagtcgaaatttcttgttggtggactttaggaatacgtatcattgctcctgagtatttctgttagtgctgaagttctgccccaaggacttcataagattaataacatcgcaaatcttctgtagtgctttaaaattttgttcttcatttttttattctcactttcttctctttccttttccacttcctcttatgttttccttaatcttcaactttcctaagcacctgcaagtgggattggagccttgtttaacatcgtccatgtagcaaaataaggatgaggccaaatatttgaaccaaggatccccatctcctatggaaggtgccctgaggttgtgggtgttgctggggacatgatgtcatggccagatcctacatcatgcggccaagggaacccagaactttcactgctctttgctactgcacatcagaacccatcgctgggagtgtcttgcactgcctgacctcaccatggatatctggctcctctgctgggtgaccctgtgtctcttggcggcaggtgggtccaggtatacttaaacatttgcataaagatgtttttggctgggcgtggtggctcacagccgtaatcccacctttttgggaggttgaggtgagtagatcaccagaggtcaagagttcgagaccagcctggtcaacgtggtgaaaccccttctctaccaaaaaatacaaaaattagccaggcgtggtagtgtgctcctgtagtcccagctacttgggaggctgaggtgggaggatcacttgaatctgggaggtagaggctgcagtgagcagagatcacgacatttcactccagcctgggcaacacagagagaccctatctcaaaaaaaaaaaagatgttttctttgggcttcccttcaccttctatggcttccgtcttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagcggtggcacagcatggctgagtcagttccctccagggtgcaaaccctctggctgctcttctcccagttgaactccaagaaaacatttgaaaaagcctcttccttatcttcctaccccagaagaaagaagcgagttgattgttgtggctgcagctgctaccgggagagtacaagaccatgaattaaggtcttaaatggtcatgatgggcacactggacaatgggctcctgaaactacccaaatacaaaatgagacattctgtggatcaggaggaatccacatgtttagaaggaagggccccagaccaatttccaagttcagagaccagctatctgaggttgatattacttaccaaaacacaaaaacattcctactgattttatctcaaacacagttctcctgcaaactcttcccccaccaacgtaccccagcagaggcaatgacatgtacatttatggaacagcctgttgactactgcagatccatctcttcaataagaccaactttccctggaggtcagtgactaaaccaaaccgcaaggcagacggcaacacgaccctcttaggggatggatgccagagaaacactgactaaaatccccactcggggactgtcctagcacattcagttcctcacacagctgcacaggggagcgcgacgttttattctgttacttcaaacactcatctgttcctctctctctcttgcaggccctagactcacagacactggaattagagtcagaaaaattgctttctaatcccaaaactggttttgtttactccccttcagctgtgaaatcttggcaaatgctcttacttctctgggactcagtgtcctcctcttcaaaattagagacttgctccacttagtctctaagatctgatacaaatatgattatttgacttgctatttatttatttatacaaatattagaatatttatgtatacatttaacataaatatatttatatttaataaaaacataaaatttataacattttatataaatttatatcaataatatatatttattgatatacttatatcacataagagatatataaatatatgcaaatatattttatgtaaattttaatacaaatataaaaaatacattttctatataagtatatataaatacttatatataaatgtattttatacatttatatataaatatatatataaatatatatttatatataaatacaaatacttatatatatttatatataagtattaatatataaatatatgtgtttatatattattatatataaataatatataaatatatgtgtttatatattattatatataaataatatataaatatatgtatttataatatttatctatttatctatctacagctattttacacatgtgacaatcagggttgcgatggaagacatcactacaagctggaaaatatgaacataattacatatgcagataacacagatccagagactatctgattgcaaggaacattatagatcacccctatataccataactttgaagctaatttgaaatgtggtttgtgaaagtattatacatttcctgcaatcccctccactgctgctagatggcagtaaaggaacgtgttagaaagtctggggaggggacctcatgatttatttaccgcgcagtcatgatttaccacgcaatcacggtttagtcttgttgtcctgtcataattaatagtatcctctttcacatacaaaagtgtctcaatttgaacattaaactatacggtcattgtagataatgacacaaatgatagcatctctgttgaaagtaaattgtttattaatgttgcagtaccttcatttctttgtttcggtttaatgaaatagattttttaaattatagaataaataaactcgaagctatagcattggtctgctttttgtcattttactatttaaatatatctcagccctacttacagtttgtattagcgatatgtggtgtatgaagcctcaacttaaaaactcagcttggtcttcgtagtgcttctgtcactgtctgcccagcacccactgcctctcaatgtgttccaacgtttcccaattcctacctgctaataaacctaccaggatatttccagacctattttctctgtgaagaaaaccaagcgacattgactttccctcattcatctactaatacataaatgtcaccacatgccagtgacaacggggtaaaataagtaataaaagtgaaataggataaaagaattgttatacatttattggctccggagaaatccaccctcttctctctagtctcctgcgcaccctgccaacaatgtcattggctgtaaaaatacctcatgttcatttaacactctacagtttactgagtaatttgttgtttcattttcatgctttaattatatgtttccaggttctctgagcttttgagctcctgctcttcccagatgggctttcataacaaggccagcccctttctctctccccttccgccagtgcccatcatttgaaccaaattttcttcctgtctctcttacttgattctttcccaacctgtgccttctgtttggtctcttaaaatatttccctattcagtgataactcccttaatgaaggcatctttattgactgccttggaaatcctcagaattatagaaacatctttcatgtccaccttggcatgttttatatgtttcacatatattttcataaataataaaaaagttatatattttccatacgtaataaaaatgtcccttcaacatgcgtaatatataacaagattagtgatcttccacctaatgtcttggacaatgtgacttctgtctgataggtatagtctttgacccctacttactcatgattaaagaaatacctttctctcaaaggaactatctgtgttcacagcgttaagtctcatcctggatgctgcaagaagacgttcaaatgtccactgcccacccaggtatgtgatgctgcctgccatgggtcactagaaggtgatagttaaaagtgtaggctctggaatcaaacaatgcagaccacaattctggctcctctgctcaaatgctatgtgaacgtgagcaagactgtgaacctctctatgcctcacttcctcacctctaaaatgaagataatagtacctacctgaggctgagcacagtggctcatgcctgtaaatcccagcattttgggaggccgaggtgggtggatcattccaggttgggagttcgagaccagcctgaccaacatggagaaaccctgtctcgactaaaaatacaaaattagctgggcgtggtggcacatacctgtaatcccagctactcaggaggctaagacaggagaatctcttgaactcgggaagcggaggttgtggtgagccaagattgcaccattacactccatcctggatgacaagagtgaaactctgtctcaataataataataataataataataataataataatacctacctgatagtattgggttaaataagataattcatgaaaatccctagtgtggtgcctaaaactcaaacgctaatatacataggtttggcctaatattatgaggtgttattatttaggattgctgtgcttcagctttttgttgagtttcacggtttggctcttactggaccactgacagaagcaactccatgactggttattctgtcattacccccagatactgtgcgataccttccaaatctactacaaacaacgagtgtgcatttctcttgcttgttccatccaagaggaaagagatctgtccagagatgtcattctgcttcagtcaacccagccgtgccagacaatatcagcataaatgtcaaaattaccatatgtggtcaacatatgctgatactgtgaccatatgctacatgggacttgttcccttaattgtgaataagagaactattcgtgtaggtgttattatccccaattttataggctcagaaagagtaataattggtccaatgtctcacaactgtatgtttcatggcaaagattggaaatgaagcaataacttttttctagtaaaattacaagaatgaccttaatttctttctaagcaaacgtagcgtatcatcacaacagttatgttaaatcagctcaataatctcctagaagaacatattataatattcattagaggtggtatgggctttaagagggagaaaaaactaggcaggatattgctatatgtgaagtaccatgctagatatttcacatatggtatttcatttcatccataccagcaacccaaaattatgttatttatccctgttttactaacaaagaaattgaagtttaaggagggtaagtgcaggatgaacactaagccaattgtagagctggcttttgtaatcagggattttatttaattcgatttgctctactatcatcatgttgaattaagaatggcaaagggctgggtgcactggctgacacctatagttctagctactcgggaaactgaggcaggagggttgcttgatcccaggagttcgaggctgcagtgagatatggtcatgccaccgaactccagcctgggtaacagaatgagaccctgtctctaaaaatttaaaaaaaaaataagaaattttcaaaaaagaataaaaattaaaatatatatatattttaaggctgggtgcggtggctcacgcctgtaatcccagcactttgggaggctgaggcgggcggatcacgaggcgggaaatcaagaccatcctggctaacatggtgaaaccccatctctactgaaaaatacaaaaaattagtcgggcgtagcggcgggcgccggtagtcccagctactcgggaggctgaggcaggagaatggcattaacccaggaggcggagcttgcagtgagctgaggatcatgctactgcactccagcctgggcgacagagtgagactccctctcaaaaacaacaacaacaacaacaacaacaaaaatttaaaaaaatgtgtgtgtgtgtgtgtgtgtgtgtgtatacatatatatactttttttttttttttaaagaatgagaaaggaactagaacaagcagagagaaaaagcccaggggcacgacagctaaaggatgactaatggaagttgaaaataggaagctgaaaggtacagaaatactgcgggaagacaaactacaaattatgtggagaaagacaagaataagaacagttcccagaggtctgaacacagcacattatgtcttcttgctatacagtggccaccaaacttgtcaatactgtaggcaaatgctagtgtcattgcttgtggctaagcagaaattttgacacttgggaaggttggcatgagattgaacagttgccatggtgacctgccatagatattttgattgatgatgagtagacacaaagtgccaatgcttaagacctagcttcagatacttaggatttagtggagaggctgttttgactatttcttttcttttcttttcttttgagacagagtgtcgctctgtctcccaggctggatggagtgcagtggcacgatctcggctcactgcaagctctgcctcccgggtttacgccattctcctgcctcagcctcccgagtagctgggactacaggcgcccactaccatgcccggctaattttatgtacttttagtagagaccgggtttcaccgtggtaaccaggatggtctccatctcctgacctcgtgatccgcccacctcggcctcccaaagtgctgggattacaggcgtgagccaccacgcccggcctgactatttctgacatctgacttaggctgcacaggaggtggggtttcttgacagggaggagctaatgtagggactgtgatgtgccaggctatttgggttggggtggagaaaccacagagagacagacataagctctctcccttatttataggacatacctactggtcctgccctaggccccagattctttgttagtggccttttctactgggagcaggtggggcattccagtttcaggtgttctgggacctggcttgaagtttttcactgatggctgcatcattaggctcgctcttttgccctttcctcagttcctgtctttttttcactttcagtcacctagaaacgacaatatccaatcagaagttgagaatgagacaagtttgggaagacattgaggaatgtctcatattgtggtattgataaatctagagatggggccacagcttgcttatagctgcttagagtaaaatgattaatcagaaaaagtaatttccaaggatttgtagtcagtctgcctgaggctaatacatttattcacagcaaaatatctgctgcctaaaatgactctgcaagttacccctacaataccagctactcagagtgatgcaatcacctggttgcaataggaaattatcctggcttcagttatctagtagaacaggtgtacatatcaatcttagagctcttgagaagacccagtagccccagacccgtgcaattatattataagcactcaagtaacttctcagctaaaggaagaatgatgaagcaggaaagagagaaaaatgatttgtattttttgtggttaacttgcttagaaattttagggaggataaactcaatcttgactaataggaaatttaattaatttagagagttattaaataatagctcctccacatcagggactatgataaatgttattaacaacacaaagaagaataagactttcccttctaggaacataccatttagtgggaagaaagacagacagatacacacacacatacacacacacatgcacatacacttaaacagaagtggtagaggctgagggaaatcccataagatagacataaagaaagtgctccatttgctcagagttagaggtgaaaaccaagaatattggcagaaaagaatgttttaaagcaactttgaatgattcttccaatgatattggaattagaaaatgaaggtttaggcagagtggggagcaggacagtcactgaagtgggaaggcacacatgggctcagcaaaaccggagcacagtgtaatatcattaggggtgaagtcaagaaaagtagcttaaaattaagccatagagaatccaaagattttaaattttcttttgatttcaaaaatgatcttttcatattattgagccagaaaataattaagtcatctatatattagacaaagttgtcaaaagcaactaaatggagggatgttaaaatgggaaagaaaaaagctagcacatttaacctatagctaacaatactgtattatacacttaaaaatgtgttagcagggtaagtctcatagcacaaacaataaaataaatttcttaaagaaaaagttaactattggaatagcctagacaagaaattatgaggctttgaactgaaacaacaggaacagaatttgaaagaggagaataaacccttgggatacagaatgaacaaaattttaacactgtctgctgtaaaaagtgagggagatcagagggattaaggtgacccttggatttcaagaataaaaatatggccaacaaatccagggaacacagatgaaagagaatattcaataaagaagacatacaaattcaaatggggtcattctgaaattgtggcacatttgagatatcctcatatctatccttataatcaaaacaaactcactatctgctcattctatgaccagtgacctcactcactgctgccttatacttcagggcttacacgtagacacacacacacacaggcacacacacacacacacacacacacacacactaagaaaagtagcttaaaattagaccatagagaatctaaaattttaaaatttagaacagatcttcatctgagccaggaaccattcatctatggcttctgtcatttaatagaataaacaaaatctgcatatgaatccatgcagaactccaagttcagcatggtttctcactgttctcagagctggtacctgaagctgcaggtgtgcattctctgccacactctgtaatggatgagtggaaattcttccataaagcttttgtctattgggagcaggtaagtctaggcaaagtatgcacaatttttttttctgggatacccagtggaaaaaaatagaaaagcatcatttttaaagtactgaaagaaaaaaagtcaacctgaaacaacctcattctagccagggaaaattagtcatttcaagaaaataagagacaatcagactagaaaggaagatataaaacaatctctaactacagttgacacttgacataatcttgtatatagaaaatatgaattctcatacacatacacatgtacacagacaactccactagatttaataggcaagctcagcaaggtgcagaataaaagattgataccaaaagttctattgtatgtctgtatgttagcaatgatatgaaaatgaaattaagagcagaattatgtgtataattccaacaaaataataaaatatcttggcataaattaaacaacaacaaaaaaaaaaaacagaaaagacttgtgggctgaaaggtgcaaaatattgttgaaattaaagacctaatagaaagatactccatgttcatgggttggagggcttaacattgttaagtggcaacactccccaaattgatttatagattcatctctgtcaaaatttcaaaattctagttgtattttttttttggaaactgataaaccaaagtaaaaattcatatggaagtcccaagtaccaagatcagccaaaacaatgttgtaaaagtagaaaaaatgttgggcaactcacacttcacaatttcaaagcttattactaaactacattattcaaaacagtatggttctggaacaggataaacatataaatcaatggaatagaattgagaaccctcaaataaattcataaatttatgggcaattaattttagacaagagtgccagccaagaccattcaatggggaaagaatggtaaatggtaccaggaaaactgtgtatgtatgtgtaaaagagtgaagttgtatcttgtctcataccataaacaaaaaataactcaaaatgaattaaagacctaaatgtagaagctaaaactcttggaagaaggcataggtatacatctttgtgaccttggtgtgtatgtaaccagcagcaaatccatatgggtctgcagtaaactcaattctagctcctaggaggagagaatttggccaaggggcagaaagaagtttaaggcagaggaaaagacccgggcaagttttagagtagtagtaaaaggaagcaaagtatacttggaagagggccaagcgggtgacctgagagacctaagggccctgtttagcccttgacttagggttttacacatcaccatggttctagggtttgtgtttctcctcccttgatgttttcaccttggggcaagctgtctgtgtgctcagtggcctgccagcacttgggaggggctgctcatgtagtgttcttactggagttgcgcacatgctcacttgaggcatttttcccttaccagtggggtgttcctagagtcatatgttagttaaactccgtcatttagcctctgtgcacatgcttgagcccactcgcccaactccagagatcttatcgggaagctgctgattacaagctccagatgtttttttatctatgtggaaactgtctttcccggatgctggttgtgactaattatcatctttgagagacagtttaacaaccacctgaccatcacctgatgatcacctgacattctggagtgtgtgtggtgggggtcggggggaggggggagagggggtctcttctcgtgccctcttcatatctgcctacctattctaacaggtatacatgaagcagattcgctgtgcactgttactaattccaggggattgtgttaattttccagggagaaatgcatgaaggatagtggaggtcatcaccatgccaaccaccacttcacagcccactgcatcttgaactgcaatttccatcacttgcctgattcatataacaagttgagcaaagcaaatttattactcacagacaggcagcaaaggacagtagaagcttaggattcatggtgagtttgtctctcaaggctcagaaaaactacacaggatggatagaatcttgcctgcatatgcctcatgttgcattgcagctgagtggctctgaaagtgcactctgtcctgggttttaaacccaggggctacatttaatgggttaaagcactgtgggacatcctgttccaggagagacaagaacagaggccaggattttcctgccagttcctcattatcacaggatgtggtattgctagcacatcctacagttattcttaagaactataaaagagaaaagggagatccacattgccaaggccatccagggacttatccttcagagtaggcagtgacttcttaaatatgaaactcaaaacacaggcaaccaaagaaaaagataaatttgacttaataacattttttaaagtctgtgcttcaaaggacactttcaagaaagacaaccccaaaatggatatatacttgcaaatcatatatctcacagggaattgtatcaaggatatataaagaactcttacaactcaataatataaagacaaataacctaatttaaaaatgagaaaggatctaaacatgtctccagagaagatctgcaaatggccaaaaaatacatgaaagatgctcagcatcattagtcgttagtgaaatgcaaatcaaaatcacaatgagataccacttcacacccagtaggctgtaataaagatacccagacaatagcaggtgtaggcatagatgtgaggaaattgggaccctcaagaattgctggtgccattgtgtaaaacagtccagcagttactcaaaagttaaacatagaatgaccatgtaacccagccatccctctcctaggtatacccctcagacaataaaaaatatgttcacgtaaaaaatttatacacacacttcaaacagtattattcatattactcaaaaagtggaaatatccatcaattgatgagtggattaactaaataggttttatttctaaaataaaactggtgataaaaaggaacaaagcactgatacatgctataccatggatgaacattgaaaagctatataaagtgaagaaggcaggcacaaaggggcacatattgttggacttcatttatataaaatgtctagaatagaccgggtgcagtgactcacgcctgtaatcccagcactttgggtggctgaggcaggcggatcatgaggtcaagagatcgagaccatcctggccaacatggtgaaaccccgtctatactaaaaatacaaaaattagcttgtagtggtgcgcgctcgtagtcccagctactcaggaggctgaggcagaagaatcacttgaacccgggaggcagaggttgcagtgagccgagatcgcaccactgcactccagcctggcaatagagcaagactcagtctccaacaacaaaaacagagtctaaaataggcaaattcttaaagacggaaaatagattaatgattgccatgggctgtgggaaggaataaaagtgaaatgacatctaatgataaagaatttctttctggggtgatagaaatattctggaattcatggtgacagttacagctttgtgaatatactaaaaaccacttaattatatatttgaaagggtggatgttatggtatgcaaattatatttcaattttaaagaaaatgtcaacactcaacatgaaaatattcaaaattacagctccaacatcagaataaagactatatttttggatctctaggattctgatatgagtaagaccatgagtcattattatttggacactaaatgttaacatgatcttatttattattcaagtcatacacctaactcctctggggtgcctatccaatggagtgagattgtgccttgtttcctgtatctttctttcactactcctgggacaaagtagactttcacataatttttattcaatgctgcaggatgagaaaggacagaaaaatgggaggaagaggctgggcgtggtggctcacgcctataatcccagcacttcaggaggccgaggtgggcagatcatgaggtcaggagatcgagatcatcctggctaacacgatgaaacccagtctctactaaaaacacaaaaaattagccaggcgtggtggtgggcgcctgtagtcccagctactcgggaggctgaggtaggagaatggcgtgaacccaggaggtggagcttgcagtgagccgagatcacgccactgcactccagcctgggtgacagagtgagactctgtctcaaataaataaataaaaaataaaaagggaggaaggaagatctctcaaacacaggcatcccatgcatgactacagagaatgatacagataggtatgcagaataacgggacctgaggtcagagggggaagtctttttagagtttgttctttgaatcacttatattgaaaattcaagtggaataagtgaaggtgacaaaagtgaattacaaatcttaaagttccctgaaaatgcttgaagccatcccttagctgaggtgtgggagtgaaaaagcaaactgagacaatgtgaaatcattttctatctcgaattttccctccagcaatgttggtgtccacttccctgtctcttaatgggtgcatctatatatcacctcttgtcaatacctctactcagcaacagccagaaaatagaaagattatataagccaataaaaggaaaataaaggaacaaaaaataagaatagtggagagatcatctacttgggaggctgaggtggggaggattgcttgagcccaggaatttgggaccagcctgggcaaacagcaagaccccatttatgaaaaaaatgaataacattatctgggtatggtggcttgtagtcctagctacttaggaggctgagatgaaggactcacttgactgatcctaggagattgaggctgtaatgagatatgattgcactgctgcactccagcctgggcagcggagctagatccagtcttgaaaaaaaaagaaaaaaaaggtgaagagggaaaaaaaagaacgagtaatagaggtgcttacttcacaacactaacctcacaaacacacactaagctaggttgtgtgtataggtcagaacaaaagatctaccatttaactgacatataagattggttctcgaaaccataggacccactggaaatggtgacctcacaggaagatgcatcttgtaggaggcagctgtgaggtctggttccccgacgtgctgcagcaagtgcctttgccctgcctgtgggctccctccatggccaactctgctatggacaccagagtactctgctgtgcggtcatctgtcttctgggggcaggtgagttttcagctaaaggatcaccatcactgggctttgttttgggctctacagcagattctcaaatataccctggacctctgtgttgaccaaatattttgtgaaaggtattgacatttatatgaaaacaaataattgcattatggagtaaaaagcaaaattcatgtgagtttttaaatgaacgcaggagacttcaaacaggctccttcactgtaagacattcatccttctgccattacaactctgtctcatgcagtctcttctcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccacccacattgatgcagagccacatcctctcagtccacaaacatcctccagacctgccttggaaacagcggtgggccaggaagggaaacgcgttacctgtacagtgaacaggtcagctctacggtattctgcaagttgagggtggaaataggggaggattgtaggaatagcatgaaacatcccaggctacgctcagaaactaagactctgtcatccaaagaacataaagatttttaagaactagacataatttttcagtttcaacattgacttaatttgtcagtttcaaaacacttagcagtgtaactctgttttttactccacactgtatgtcaagttctatatttcatgctttacatcaataattttatttaatcaccaagacacacaagcaaaggaagtgctttcttccttttcaccaagagaaattatggtcctaggagttaatttttagaaagaaagagacagagagatgggggaagaaaggggaggggaggggacaggaggagaagggaagggaggggaagggaggggaggggaggggaggggagggaagggagaaggaaacctagtaggtggcaaaaagcatttggctcaaagggttatgatttttatctcacatcatgctgcttagcattcttttaggcataatccttgttctgttccttgctgagtacccgtgcaggtttttacggatgctaggttcaagaattcctgctataaaattatagaacatctgagagatgatggaaatagagttggataaatttgtctagaatttagggaaaaggtctggcccacagatattgttcattagaaatgtgtcacctcaactttttgtcttaatgtttgtttttattctcatcactcaacagatataggccacctacagaaaaagatttgttataatttgctttgatgaaacaatttcataaaatcaaaaggcagacaaaagcaaagtcatttcaaatatatgtgcagactaagtccagcctcaccagcttggagtataaaccatgtgattccactgcagtttttgccctttgattttctaaaatcatttaatgtactcctgcccctccctcactttacccaaaaggagaaaaacccagaaaatcttccaggaagacagaagagggacaccggcttgggagcctgagaaagatccagagagatttccagaaaaagaccaaccctgagaccccagcaaggctgcagagaagatggattccaaacttcatgccatttaaagcaccagacatgtaatttaaagaaacagtcttccaaaggtagtgctttacagggaggggaaaaaaaggcaaagaggaagaaagagggtcttctggcaattcaatagtgaggagaaaaagaggaaaaaggggaaaactgagaattctgcaaaacaaaaggaaatcacaaatcaagaggacccacaaccagccccactacgaaaacaaacaaagctcactaaggagtctggattttgctagaatgatggccaaaggaacattagactaggaattttgtaaaacacctcaataacacgaaaatgagcaagatgaaagtaatacccgtacaacaaaggaaaacatctcacctctgttccctgttccctcatctcaaaagcaatcatgagtcagaagataatgtaagtctacactccaaacagaaataaatacactcaaggaagcagctgaggatataagtgaccataaccagaccaggactttaaaaactcagactacaaatggccaaaatgggaagacatcagaaaaaaacacaaattgattgaacccaggagggacatgaaagaaaaagacaaagttatcccagtcatgcaaaataaaagatgaccaagggagaataaacccaaatgaaaatttagtcaggacattgaacaaaggcaaagaaacaagtagcagaatgagaaggacatgagtgaaaccagccagttagaaggcggtcaaagaaggcgaggtcttggtatgattgcatgaggggcctggaacagcagcactgggctctgtgcagcaggacggctaagcagcaggttgtcacagtggccacagcactactggccagaccccaggagtcacagtttccctgagagagctgagggcataaacaatgataagttctccaggggatggacttcttaaatactctgagttcatcattacacattctatgcatgtagcaaaataccacaggcacccacaaataggtacacatattatgtatcaatgtttttttaaaaaaaggaaaaataaatgaattccacattcttgtataatcagagtatctacagcgctcctggagtaacccaaaccttatggttgctggaaagataaaaaaccaatgggccaattggggtgaaactctggcccggaaacgtggggtgccagccccctcagcacagatgcaatgcagagttatgggaggtgcgaatgactctgctctctgtcctgtctcctcatctgcaaaattaggaagcctgtcttgattatctccaggaacctcccacctcttcattccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtttcctgggagcaagtgagtcctgggttcagggagaaaattcctatctggagtgctgcaagttccaaatctaaggcctccccgagggacagcagcatcaggcgcctccctgggctgtactcaggcatgcctctctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtatagacacagtgaagcacggatgtcgcctctctgtgcataaatgtgcccagtcctgcttccccgaccaggtgacagggctcctctgcactctatgatggcaggaaacgccactcagccactaagcaggtttaaaaaactgtatataactaaaactctatatataaactatgcatataaaactaaactatatatgtatacatttatatataactaaaactttatatgagactaaaatgatagttttatatagttttttaaagtatagttttatatatatataactatatatatatatcattttttaaactatagttttgtagttttatttatttatttactttttggagatggagtctcactctgttgcccaggctgcagtgcagtggcatgatctcagctcactgcaatctctgcctcctgggttcaagcaattttcctgcctcagcctcccaagtagctgggattacaggtgcataccaccacacctggctaatttttgtattttagtagaggcagggtttcaccatgttggccaggatggtctcgaactcctgacctcaggtgatccacccacctcggcctcccaaagtgctgggattacaggcatgagtcaccgtgcctggctgttttatagtttcatatagttatttttaaaaactatataaaagtttttgtatagccacttagtggctgagtgaagtttcctgtcatatatgatatagatatagatatgtttatatatgatatagatacagatatgttatatatatgttatatgttgtatataagatatatacatatagagagagtcagagagacacagagaagaaggaaaagttaatcttacaacccccagcttttttctattttaccgaatgctagatgaatagatggatgaatgaatagaaatgaatgaatgaatagaaaattttcccttctttcaggaagataaaaaagcctgtggaaagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 118 - DNA, 107958 bp, Homo sapiens
gacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 119 - DNA, 164044 bp, Homo sapiens
tgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 120 - DNA, 120559 bp, Homo sapiens
tccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatgagtcagtgaagaaaagaatgaaagtttactgtttagcagtgtggatctctaatccgacttaaaactccttgttcccgattcctattcctcctaagccagagatccctgggtccagggtgagggcacggcattcatgcttacccacgggctggtcaacaaagaggtgctgacctgagagtagggcacataacctcagccactggggtacacttaccacccccgcccccgtgtagctccctcccctatcctgaaatctcccttagcacactaagtattctaggttaaacagcccagatgttcagggagttcattcgccacaaacacacattaaaatgcagacaatttgcctgtgagatgaggaaaattctctggaagatttaggccctgagagctgaaaagggaccctaaacattacctggtgacaactgccctgaggccagagaagagaactcacaatattggtatattaaccggtaccatttgtagttaggctgtcattaatctgggtgtaatggggctcagctacagagaagcgtatccagaggaaatgtggggttcctgcagtcagctggggcaccgaaaagacccagactttagaaccagataaaggctgagttcgaacctctggttcttttgtgatgtggtgaccttgggcaaattaatgtgtgaacctcagtttcctcaactataaaatgtaatgaacaatacctaccacttactattgctgtgaggaagaaaagagagtcaacatgtaccgtgtacagattattgatgtaattcaatggttcttttccccatcctcctaggaggtcactggggagacagggggcagggtcagcccagtgccaaaggatgggcaggatctgaagtgtggaaatggagtaaggctgtgtctgtgtcagaggtgggttgggaagatgtgagacaaacatcacaattttgcctaaggtgaatccaacccacaagtagagcacaggccaacagcagctcactagtacacatacttacaccagcagctcactagtacacacacttacaccagacgctcactggtacacactcacaccagagctcattagaacacacacaccgtcagcttgctagtacacacacttacaccagaagctcactagtatacacttacaccagaagctcactagtacacacacttactccagaagctcactagtacacacacttacacccacagagacaagccccacaccacacggactcacaaatgcagaagaagagttgaccctgccctcatgtacagatagtatgctggtgtgtagtgagaggcggctagtgttcgcca
